United States Patent 7,745,391 (HUMAN THROMBOSPONDIN POLYPEPTIDE) - sequence listing, part 148

SEQ ID NO: 383206 - DNA, 1867 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagggtacaggattgcagcgtgcctggaagggaaagaaagcgaggaagggtgttgggaagtggggttgtggtagtggcaagaaagggcttctctgtcctgtgtaattggaagaaagggtgataaaggactgtgtgtatgaatatgggccttaagttttggggctttctccccttctgttgcctttctgattctgcccagttgtcagctggtatgggatgttgggcttgggataccagggtttcgcatatctggagaaagcctggctcatggaccgtctttgtcttgcttagagttcctatcagactgagattgggcagaccctggacctcctcacagccccccagggcaatgtggatcttgtcagattcactgaaaagaggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383207 - DNA, 1303 bp, Homo sapiens
aatacggctaggtacgaggctgggtgttaatcggccgaggggggagagcgggaactactcgacccacagagccgatcgcggagcggattctgcttttaggagtacccgccaacaagcgggaccgagcaggaatccgtatctgggaacagagccctttgctcctccctcagaatgaacggagaccagaattcagatgtttatgcccaagaaaagcaggatttcgttcagcacttctcccagatcgttagggtgctgactgaggatgagatggggcacccagagataggagatgctattgcccggctcaaggaggtcctggagtacaatgccattggaggcaagtataaccggggtttgacggtggtagtagcattccgggagctggtggagccaaggaaacaggatgctgatagtctccagcgggcctggactgtgggctggtgtgtggaactgctgcaagctttcttcctggtggcagatgacatcatggattcatcccttacccgccggggacagatctgctggtatcagaagccgggcgtgggtttggatgccatcaatgatgctaacctcctggaagcatgtatctaccgcctgctgaagctctattgccgggagcagccctattacctgaacctgatcgagctcttcctgcaggtacaaatctattgtcaagtacaagacagctttctactccttctaccttcctatagctgcagccatgtacatggcaggaattgatggcgagaaggagcacgccaatgccaagaagatcctgctggagatgggggagttctttcagattcaggatgattaccttgacctctttggggaccccagtgtgaccggcaaaattggcactgacatccaggacaacaaatgcagctggctggtggttcagtgtctgcaacgggccactccagaacagtaccagatcctgaaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttaaaaaaaaaaaatcgggattctttgggggggaaaaagttgaaggcacggctactgttctgcccttttgacaggggaatcgcccaagagctatcgaccgactag

SEQ ID NO: 383208 - DNA, 299 bp, Homo sapiens
gttctgaaagatgctaaaacattaacatggcaaatatttactttttgacacacaaacagcaaagagtaatctttagatttatgattttatttatacagttctacaactgtatatcaaaaataaggagattatataaaatcttaaaacaattaaagcaagaatgtattcaccaattcaaatatgaaaactgtgtttcggtgtcagtatgtatttcttaaatcagtcaaatactaaagataatgtgcaactgaagagcaaagaccaagtggacagttgaatcagtgtatcgagtcatatga

SEQ ID NO: 383209 - DNA, 142 bp, Homo sapiens
  misc_feature (5)..(5): n is a, c, g, or t
  misc_feature (32)..(32): n is a, c, g, or t
ctgangggaagaggtcaatgggaatgggtggnggtggttaaagggagtgggtttcttttggggagatgaaaatgttctacagttgattgtggtgatggttgcataaactctgatcacacaaaagtcattagattgtatactt

SEQ ID NO: 383210 - DNA, 116 bp, Homo sapiens
agctccctggtgattatagtgtgcagcagaatgtgagaaccacaccttgaaaccattgtgccatggccctaccaaatggatgagtcagcagattaaatcttccccaaaatatgaca

SEQ ID NO: 383211 - DNA, 343 bp, Homo sapiens
agcaaaaagcatacatcctttggggaccgtccccttcctccctcccgtcctgccttcccagcttggctgtgtgtttgaagctccggtgaaagtgtcatatggtttgcgtcgggattctggagccagttgcctcaaaccttgttttctcattattagactattttttttgtttgttttaagtacatacttctgccaccttctctccctaccttgatgccttcaaccaaaaaatgaaaggaaaggaatgttttcctgcaggtgatttagaaggtgtgcaaggccagatgttttggtgaattttagcagatttcgcctgcatgccctccttctcctggagcagctg

SEQ ID NO: 383212 - DNA, 1736 bp, Homo sapiens
acagtttttttttttacttgatcattctttttatttttacaaagcatggcaaaatgaggaaaccactgacaggtgaagaatttgcacaatggaaaaccaccttgaccatctcatgactttatacaggaatcggaggtaagtgttcctttaaagtgattttgtcatgaaagagtcatctgaaatgactctcgtgatggaggaaaggaaagtaatgaaatcaacattcatggttatttaaaatgccttaaaagctaagcataatatacatagtaactccttttcctagtataaaaatagtgccagaaactatatttgttcaaatatattgaaaaggtataagaatacaaatagatattaacagtggctagtgatgcctcataaggttttcttaaactgtaatataaatttatattttcaactatttacattgctttcaacaacattcattaagacatgtttacacaggcttttagtaagtatatggaatggtaaagtgagctttaatactttcttcttcactctctgtagtagagcagaaggggtccaaaaccatgcacaatttaacagtccagaagaactgtgtaatctttacctggctagcacatggaaaaaataaactatatacaagaatacaaaactcctaaagtgttcttcaactatcagcaggttaagtgattcatacttgcaaaaagacaggatgtttgtttactggtagattcttagtaagtttcaggtaaagaaggtgcataaaacatatgttattgatgaaaatggaaatgatgcagtataccccatgttctcacattaaattggcagtatcagaagctaagtctcttctctagcacctccttcagggaccgtgagctccttggggtcactgctctgtctccacagcagagcacggtacctaacatgtggcaggactcaataaaaggtgggtcagtgtatttctgatacaaaacaattaaattgtgccaccttattttgactacagttgttcataagagaggataacgatgacattttgtatcctctcatattaaatcaatcttgtaaacaaaagacaattgcttgtgatggcctgttaagttttaggagtacaatctggtgaaaaacacagaaaaaaattgtagatcaaattggaacaggtctaatatttatttgctatgctgaaaataaaggcacttcactgctaggcaagaatatatctgtgactgaacagttttctccaagaatccaatatttccagtatattttcatatactttcttatctctaatactcctattaaaggaaactattattcaaaattaagagacagtggtgacaacatcatcatcctgggtttgtaccttgaagcaatatactcaatgagctctaaatctcacattcactagtgatctgcaagtgaagctgaataaatatattctctttgttcagtcatggaaactcaacattagaaatgacatgtgggaatagatcaccttctctctagactaatatcccatttctgacagtggtctccatggcccattggggcttataaagtagctgccttctgtgacattctgcttgaagacaaaggctttgcccaaacataactccttttaaaaaagcacaacttgtttaggcacacagaggttaagtgacttacacaaatccacccaggattgtgattggcacggtctaatctactgaaaaatataaggccaggcaattatatagatatcttttaac

SEQ ID NO: 383213 - DNA, 522 bp, Homo sapiens
  misc_feature (519)..(521): n is a, c, g, or t
gaaagatattactggctataatctgatgcatccattgcacctagtgaaggctcaccatatggtcagaatactcgatgcacactgatacaactctctacatccatctctgtgttagggacaaatgttactttactcttgcacagaacttggacagtcacttttaatatctgtcttttctttttctattttcattactgataccctctgccccttctttctgactaaaactctcattcaataaaattatagtcaaatcttgcaattggaaaagtattcagacttttaaagttatatttatatatctaaatgttgctccattagggttttaattctaaatttaacctttaaaaagttatcatattttctttatttccaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383214 - DNA, 889 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctggctggcagcctgttatcaattacattgatattaaatttgaggactacctaaatgcagaatcgcgagtgaacagatgtcagatgcctggtaacagggtgcagtgttgtttatacttcattgctccttcaggacatggagacagatctcattatgttgcccaggtgatccttgatctcctggcctcaagtgatcctccaacttggtctcccaaagtgctgggattacagatgtgaactaccaacccagtcaacgtgcagaaggttttcagtttgatgtagtctgatgtagtctcatgtattttatccttgtggtgttgcctgagctttggtgtgatatccaaaatatcattgcagatcatatcagaactttcccctatgttcttacagaactttatggttcagattccatcaattggatatcgggctgcgcggaaagggccggccccggtggttcattctaacatttggggaattcgccccgggtctgaggctggcaaaagtt

SEQ ID NO: 383215 - DNA, 570 bp, Homo sapiens
  misc_feature (567)..(569): n is a, c, g, or t
gtctatgacatgtaagacaaattatccacaaccatgacattttccatgctacaactgtaggtacataagtatagtccagaaatcaaattcttagttttgtcacccttgtaaagcagcaggaacactggaaattttcccccttatatttgggatctacttgagaacctcccttcaccccacacaaaacccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383216 - DNA, 746 bp, Homo sapiens
gtctatgacatgtaagacaaattatccacaaccatgacattttccatgctacaactgtaggtacataagtatagtccagaaatcaaattcttagttttgtcacccttgtaaagcagcaggaacactggaaattttcccccttatatttgggatctacttgagaacctcccttcaccccacacaaaacccgactaaagaaatcatttcttttcctttctttttatttacaaagaatttttctctccaaaatctacatttgcctacttttggctctgtcatcaagtagggtgatacaaaatgtatgccaagaaaagtctgattgtttcattttttatttttttcttacttgtctgacacagtgacaggatcacagaatgtgaattttgaacagatctgaaaagttattaagttcaactccacagaggtgagtaatgtgcccataagtgtggctgaagatgagtggcgctaacacaatgctgtgagtccgacccccagtccagcactctttccatgtcgtctaactcgctctcatttaccttcacataaagtgacaaaggggcctgatgcgtaacttcctccagccactccccgttcccagttattattccaaagaaatgttgctggggaaaagtgaagatgtgacttgatggggcaagctgccactctgccttccttcctatgataacttactagtaaataatgcattccttctggaatttaatttcacattttcaaaggccaaagac

SEQ ID NO: 383217 - DNA, 586 bp, Homo sapiens
atgcacatttaagttatgtattacatgtctttagtggtgatcactattttatcagttcctctgtctttctttataccaagtatgactcataaacccagtattaatttgccaagagattggcatactatttgtatatatgcttttctttcaaataatctggatttccaatgcccacaatcattgatcctaaagaaaatgtgggagtaggtaaactcaaacatccctaccatcacccctggtaggaaatcactggtgtaatgtatgatattaacatctgcaccaattactgttataggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatgggtcagtaacctgatagttctgattcctttttgttgttgttgcttactgttacctttatg

SEQ ID NO: 383218 - DNA, 467 bp, Homo sapiens
  misc_feature (464)..(466): n is a, c, g, or t
ttattaacaagccatgagaagtcagaaatcctttcaagctcttgtactctgcttctttgaccatcacaagagaattcaactttctgtttaacttagaaaggcttgggataaagggctcaagcacctcttactgcctcctcactctggaaccaaatgccttactgtctgcactgctccccattgccttccctcccgcctcaccagttgatccctatacctccttcccaatgacctccaggaggcctctaacttacagtgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383219 - DNA, 374 bp, Homo sapiens
  misc_feature (371)..(373): n is a, c, g, or t
ttattaacaagccatgagaagtcagaaatcctttcaagctcttgtactctgcttctttgaccatcacaagagaattcaactttctgtttaacttagaaaggcttgggataaagggctcaagcacctcttactgcctcctcactctggaaccaaatgccttacttgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383220 - DNA, 434 bp, Homo sapiens
gtctatgacatgtaagacaaattatccacaaccatgacattttccatgctacaactgtaggtacataagtatagtccagaaatcaaattcttagttttgtcacccttgtaaagcagcaggaacactggaaattttcccccttatatttgggatctacttgagaacctcccttcaccccacacaaaacccgactaaagaaatcatttcttttcctttctttttatttacaaagaatttttctctccaaaatctacatttgcctacttttggctctgtcatcaagtagggtgatacaaaatgtatgccaatcatccgcggttggtgtagtgaaaaagggctggactgtgaagcattgctcctaggaacctctgaggagtgtgagctgaattaatctatagcagatctggtggggactcctcgtagaggtcgacgcg

SEQ ID NO: 383221 - DNA, 1537 bp, Homo sapiens
  misc_feature (1534)..(1536): n is a, c, g, or t
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagtgagttggactatggatcaggtactgtgctcagcatcagaaaatgggatgacaatgaacagagtaacaggactatatttctgaaaaaggatgaacttactggaaacaggattgcgtgcctgaaatatacccaaatggatataaatgtcaactcagttctgggctggagatatagatttggaatgcaccaacaatgcagatggtaatcctggcatgcgagtagggctcaagcacctcttactgcctcctcactctggaaccaaatgccttacttgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383222 - DNA, 1753 bp, Homo sapiens
  misc_feature (1750)..(1752): n is a, c, g, or t
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggttagatcttgggacagcccacatacctagacaaacttaggctttccagcttgcactggaccagggtggaaaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagtgagttggactatggatcaggtactgtgctcagcatcagaaaatgggatgacaatgaacagagtaacaggactatatttctgaaaaaggatgaacttactggaaacaggattgcgtgcctgaaatatacccaaatggatataaatgtcaactcagttctgggctggagatatagatttggaatgcaccaacaatgcagatggtaatcctggcatgcgagtaggtgagatcatccagggagatggcctataatgagagcctacaacatgtcagggctcaagcacctcttactgcctcctcactctggaaccaaatgccttactgtctgcactgctccccattgccttccctcccgcctcaccagttgatccctatacctccttcccaatgacctccaggaggcctctaacttacagtgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383223 - DNA, 1467 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagggcagggttccactcccattgcccaggctggagtgcagtggcgtgatcttggctcactgcaaccccctcctcccctattcaagcaattcttctgcctcagtcttctaagtggctgggactacaagcgcgtgccaccacacccgcgcttataatagaaaataatttttctgtttttttgtagggatggggtttcaccatgttggccaggctggcctcgaactcctgagctcaagtgatcaacctgcctctgcctcccaaagtgctgggattacaggtgtaagccaccatgcccggcctctgatttttctatagtgagaacataactatttctgtaataatattaaaaatacttgtcagtatcacatagaattttcaacagcagattcaaataaaatgaatccttgtgtgtgtgt

SEQ ID NO: 383224 - DNA, 1378 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagtgagttggactatggatcaggtactgtgctcagcatcagaaaatgggatgacaatgaacagagtaacaggactatatttctgaaaaaggatgaacttactggaaacaggattgcgtgcctgaaatatacccaaatggatataaatgtcaactcagttctgggctggagatatagatttggaatgcaccaacaatgcagatggtaatcctggcatgcgagtaggtgagatcatccagggagatggcctataatgagagcctacaacatgtcaggtgtacaaagcaaacttctaatgcactgctggtttacatttcctgtattttc

SEQ ID NO: 383225 - DNA, 1593 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagtgagttggactatggatcaggtactgtgctcagcatcagaaaatgggatgacaatgaacagagtaacaggactatatttctgaaaaaggatgaacttactggaaacaggattgcgtgcctgaaatatacccaaatggatataaatgtcaactcagttctgggctggagatatagatttggaatgcaccaacaatgcagatggtaatcctggcatgcgagtaggtgagatcatccagggagatggcctataatgagagcctacaacatgtcagtcagatctccaggctctcaagatctccaacctgaccagagatcatctcattcatgggtaaaatggactttacccagtttgaacttcacacatgattttgtgctgtgtgtagtgcccttttaagtctctcacatcctgctgaccctctattcccactgtgccagaccatgacttcagctcacttctgtcctctattagagcagagaagacagtcatgggatagaacaagttctcccaggacaaatatacagtgtgactgtggctacca

SEQ ID NO: 383226 - DNA, 875 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggtaatttcagtttttattattattagtagtagtagtatactttaagttctacggtatatcttcacaatgtgcaggtttgttacatatgtatacatgtgccatgtttgttt

SEQ ID NO: 383227 - DNA, 610 bp, Homo sapiens
cttacaatagttgataccccaggatttggagatgcagtggataacagtaattggtaagaaggatttgtcctcacaactttccagtgtatttggggtattggggtggttaaactttctcttcttaacattttaaaactcttcttagcaaaggtcaccaaacttcaagtaacatgacaggtttgtataccaactttgccacttatttgacaaagtttaacttcaaagttaaacaaagaagtttaacttctttgaacccatttacttttcgataaaatggagataatacctatcataaaattgtttttaagacatattccaaaataacgtagctagatagaagaattctcattattgtaagaaatttaaaactgtttgctttaattttatccatttgtataaattctatctcaatcctaatttaaacctgatatttagaccttcagtttttccataagtcctaagtgaagaaaacaactatgaaattttagtctgaagtaattatcttagtattttataaataacttttatttttgtttgaattcacattgtttttgaggtatttttctgtcaactcttaaaactcctaagttcatcatgaagtttttatatt

SEQ ID NO: 383228 - DNA, 2635 bp, Homo sapiens
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggttagatcttgggacagcccacatacctagacaaacttaggctttccagcttgcactggaccagggtggaaaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggaggtaagtgttcctttaaagtgattttgtcatgaaagagtcatctgaaatgactctcgtgatggaggaaaggaaagtaatgaaatcaacattcatggttatttaaaatgccttaaaagctaagcataatatacatagtaactccttttcctagtataaaaatagtgccagaaactatatttgttcaaatatattgaaaaggtataagaatacaaatagatattaacagtggctagtgatgcctcataaggttttcttaaactgtaatataaatttatattttcaactatttacattgctttcaacaacattcattaagacatgtttacacaggcttttagtaagtatatggaatggtaaagtgagctttaatactttcttcttcactctctgtagtagagcagaaggggtccaaaaccatgcacaatttaacagtccagaagaactgtgtaatctttacctggctagcacatggaaaaaataaactatatacaagaatacaaaactcctaaagtgttcttcaactatcagcaggttaagtgattcatacttgcaaaaagacaggatgtttgtttactggtagattcttagtaagtttcaggtaaagaaggtgcataaaacatatgttattgatgaaaatggaaatgatgcagtataccccatgttctcacattaaattggcagtatcagaagctaagtctcttctctagcacctccttcagggaccgtgagctccttggggtcactgctctgtctccacagcagagcacggtacctaacatgtggcaggactcaataaaaggtgggtcagtgtatttctgatacaaaacaattaaattgtgccaccttattttgactacagttgttcataagagaggataacgatgacattttgtatcctctcatattaaatcaatcttgtaaacaaaagacaattgcttgtgatggcctgttaagttttaggagtacaatctggtgaaaaacacagaaaaaaattgtagatcaaattggaacaggtctaatatttatttgctatgctgaaaataaaggcacttcactgctaggcaagaatatatctgtgactgaacagttttctccaagaatccaatatttccagtatattttcatatactttcttatctctaatactcctattaaaggaaactattattcaaaattaagagacagtggtgacaacatcatcatcctgggtttgtaccttgaagcaatatactcaatgagctctaaatctcacattcactagtgatctgcaagtgaagctgaataaatatattctctttgttcagtcatggaaactcaacattagaaatgacatgtgggaatagatcaccttctctctagactaatatcccatttctgacagtggtctccatggcccattggggcttataaagtagctgccttctgtgacattctgcttgaagacaaaggctttgcccaaacataactccttttaaaaaagcacaacttgtttaggcacacagaggttaagtgacttacacaaatccacccaggattgtgattggcacggtctaatctactgaaaaatataaggccaggcaattatatagatatcttttaac

SEQ ID NO: 383229 - DNA, 1898 bp, Homo sapiens
  misc_feature (1895)..(1897): n is a, c, g, or t
cgcgctcttgtgaggtcgcaggggaccgccactcacgcggagccaatcggaactcgcggcggggctgctgggtcttccaggagcgcgcttgagcggacgctgcctaccggtggccgggcgggatgtaacccgctgctgagctggcagctctgtgtcgctaggcttcggcccggccgccgccgcacataagctgcgaggaggagctttacgacttcccggtcttcggggccgggcgcagcaagggccagactctgcgctagcaggcgctgcgcgccaaccggccggcacctgtcgcagaaggtgcaaccgatcgcactgtcgcgccgaagctcctcaatggccagcgccagctgcagccccggccgcccactcgcctcacctgagcctgggagcttgaaaaatcacatttgagaagaggattggatcctagccataacataaatataagggtggaaccaaagttttaatcaaagaaggtggtgttcagttgctgcttacaatagttgataccccaggatttggagatgcagtggataacagtaattgctggcagcctgttatcaattacattgatattaaatttgaggactacctaaatgcagaatcgcgagtgaacagatgtcagatgcctggtaacagggtgcagtgttgtttatacttcattgctccttcaggacatggaccattacataactgaagactcccaccttcaggcaggattgggtagtacgtgtttgtaactacctggcattgccttttgttgaggaagggtagatgtctacccaaatggaatattgagtatcagagacttcaaatgataacttttgtttgtttggagaaaatcttgaggacgtgatcactgtacaaaagcatggcaaaatgaggaaaccactgacaggtgaagaatttgcacaatggaaaaccaccttgaccatctcatgactttatacaggaatcggagacatccaaggccattccatttctaaatcacacttatccctcaatcaagtcagtgactggatcatctcctaaggtttcacctgctttgcatcagggcagggttccactcccattgcccaggctggagtgcagtggcgtgatcttggctcactgcaaccccctcctcccctattcaagcaattcttctgcctcagtcttctaagtggctgggactacaagcgcgtgccaccacacccgcgcttataatagaaaataatttttctgtttttttgtagggatggggtttcaccatgttggccaggctggcctcgaactcctgagctcaagtgatcaacctgcctctgcctcccaaagtgctgggattacaggtgtaagccaccatgcccggcctctgatttttctatatgagttggactatggatcaggtactgtgctcagcatcagaaaatgggatgacaatgaacagagtaacaggactatatttctgaaaaaggatgaacttactggaaacaggattgcgtgcctgaaatatacccaaatggatataaatgtcaactcagttctgggctggagatatagatttggaatgcaccaacaatgcagatggtaatcctggcatgcgagtaggtgagatcatccagggagatggcctataatgagagcctacaacatgtcagggctcaagcacctcttactgcctcctcactctggaaccaaatgccttacttgacaggatcacagaatgtgaattttgaacagatctgaaaagttattaagttcaactccacagaggttcctaggagaatgttaacagtccagacctttttcactacatcaaccacggatgattggcatataaaatcctacttaacctttacataactgcaataccaggaaacaaatatgtcaataaaaggaaacatcattcaaaaaannna

SEQ ID NO: 383230 - DNA, 489 bp, Homo sapiens
ctttctctgagcctatactacttaattaaaatctgcttggaaaatctcagttaagttagtaaaatcatctagttctaacaactattgtctgtttacagccttaggcaatttagtgggcaaaactgtaattgtgtatttctaaacatgagaaatttcaagatttctcctctgaggggtatcagggcatataaaatcaatcatgtaaatatttgcttcttttactttcaggattacacaaatatatttttaaataccaagtcttttttgagaaaacaaaaacaaacatttgctccgtgattctttccttttctgatttttaactgtgtgaaaaactagaaagatcaagtccttcaaggcttttatgccagtttgcctaggagagatacctgccccaagccccaattttaattactcaagccagttgaatggtgtgtgtatgtcagcctaggcaagcgacttcacagttatattttaaatatgaagatttca

SEQ ID NO: 383231 - DNA, 385 bp, Homo sapiens
gttactgtggaagaaaaaaatgaataatcccctcaaaattccaatcaggttctgttactactttttaaagtccctttgatagcttttcatcatctttaaaaaagcctctcatcatccttcttaaatatatttctcagctcccgctccattatggcctgattttcttctggttgctcctgcttttaccttttacccctccgtcagaggggccttggcacaggactgctgttccctcttttctcctgttcattcttcaggatcctgcctcattttctaaagtcctcaggggaaggcattcccaggacttccttaaggggcagggggcccatttccaattggctgttcaggaggactttccaggaggctggcagtaccttgtgattct

SEQ ID NO: 383232 - DNA, 589 bp, Homo sapiens
tgcttaaccgcatccctggtctctactcactcaatgccagtagccttcttcctgcctgttgtgacatcaaaaatgtcatacattgccaaatgtccccaagaaagagtggggctgagggaggacaaaatcctacccacagtttaaaaccaccgccttatctcatcctcacagtaactaaccacagtaaccccagggtggtaagtactgttaatgccccatattgcaagtgaggagaccaacagaacagagtttgggtgacattcctgagaacacacagctccgagattcacgcccaggcactgtgactccagagctcacctgcccattatgcaagaacatctgatcttggctgggagcagtggctcacacctgtaatcccagcactttgggagtccaaggcgggcagatcacgaggtcaggagatcgagaccgtcctggccaacatggtgaaaccctgtctctactaaaaatacaaaaaattagccttggtggcaggtgcctgtaatcccagctacttgggaggctgaggcaagaggactgcctgaggccaggagttcgagaccagcttaggcaacatagcaagaccctg

SEQ ID NO: 383233 - DNA, 485 bp, Homo sapiens
aaccaccgccttatctcatcctcacagtaactaaccacagtaaccccagggtggtaagtactgttaatgccccatattgcaagtgaggagaccaacagaacagagtttgggtgacattcctgagaacacacagctccgagattcacgcccaggcactgtgactccagagctcacctgcccattatgcaagaacatctgatcttggctgggagcagtggctcacacctgtaatcccagcactttgggagtccaaggcgggcagatcacgaggtcaggagatcgagaccgtcctggccaacatggtgaaaccctgtctctactaaaaatacaaaaaattagccttggtggcaggtgcctgtaatcccagctacttgggaggctgaggcaggataatcgcttgaaccagggaggcgaggttgcagtgagccgagattgtgccactgcactccagcctgggtgacagagcaagactctgtctcaaaaaa

SEQ ID NO: 383234 - DNA, 1708 bp, Homo sapiens
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgtgagcgtccccgccccgccccgcgccgggcctccttctcgccccgagccccagacaccgcccctgcgccggtgaccttggacggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtaaaaaaaaaaac

SEQ ID NO: 383235 - DNA, 1756 bp, Homo sapiens
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcagctggccttgctgaacacctgagctcaacccctaccatccgactcccgaggtgttctgtccaggatggatagaggggaaagatccaaggagggacgtttacacacagatcttggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggcaagtggcctgcgacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtaaaaaaaaaaac

SEQ ID NO: 383236 - DNA, 1491 bp, Homo sapiens
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgtgagcgtccccgccccgccccgcgccgggcctccttctcgccccgagccccagacaccgcccctgcgccggtgaccttggacggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggcaagtggcctgcgacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtaaaaaaaaaaac

SEQ ID NO: 383237 - DNA, 726 bp, Homo sapiens
agggaagtcgggggaacaccatgtggtgtaagccatcaggaggcggggcacatgtcccttgccagtgctggtggtgacagtgacccgcagtcagtccctgttgactgagcactggctgcgcgtgctgacggcctccttgccgcatctcgtgccatcctcacacccgctgcgaaggcgggtgtgcgtgcagtcacccctttacagaggaaacaagttttggcaaggccagatgcctgcctggatacccaggtttccaccctaggcggctgcgctccaggtctccactgctgagctgaatgccgctttcccacccacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaag

SEQ ID NO: 383238 - DNA, 1624 bp, Homo sapiens
gcgcgtgttcctttagggaccgcgcgcgccgcggcctcgctctggggccggtacttgcgcgcccgcaccccgcgctccccgccccgctccccgtcccgcgctccacgcgcgccccagcgttgggggcttctcctccgcggcgggaatgtctggccggctccggcagcacggcgcggcccaggtccccgcgcccacgacgggccagcgcgctgggccatgatccggctgggcggctggtgtgcgcggcggctctgcagcgcggcggttcccgcggggcggcgcggggcggcgggcgggctgggcctggcgggaggccgcgccctacgggtgctggtggacatggacggcgtgctggctgacttcgagggcggattcctcaggaagttccgcgcgcgctttcccgaccagcccttcatcgcgctggaggaccggcgcggcttctgggtgtcggagcagtacggccgcctgcggccagggctgagcgagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtaaaaaaaaaaac

SEQ ID NO: 383239 - DNA, 1421 bp, Homo sapiens
ggcctcaggtcccagagagctccagcaggtgtaggagtccatgggcctgacacctttgctggtctctgctggatcccgacgaagtcaggtcctttctggaaaggggttcgaagtccacatactctccgcactacccccaggaagtacgtccttgggtgtgtgtttgggggagtgagaggaatgaagaaccactccccctatagcctggccatactccccaagatgagggcagtaaggtgctgaggaccctggaagtaacttgcttttctcaacttctcaggagaaggccatcagcatttgggagtcaaagaatttcttttttgaacttgagcctctgccaggggccgtggaagctgtcaaggagatggccagcctacaaaacactgacgtcttcatctgcacaagccccatcaagatgttcaagtactgtccctatgagaagtatgcctgggtggagaagtactttggccctgactttctggagcagattgtgctgaccagagacaagaccgtggtctctgctgaccttctcatagacgaccggccggacatcacaggggccgagccaacccccagctgggagcatgtcctcttcaccgcctgccacaaccagcacctgcagctgcagcccccccgccgcaggctgcactcgtgggcggacgactggaaggccattctggacagcaagcggccctgctgagctggactgtgcttcgggctcctctgtggggctctgacctcagggctcccagctcggggcctgtggggccagtatgctggtctgggagtccctcctagactcctgggccccatgacctcctgctgcatgtcccttcccttccccagccctgccaggccttaacctgatcacggggcagggctgggccctctgggcgcttggacatagacacgtggtcccaggccgttcagcctgacctcaggcagcaggcaccaagctgccagaagcccaggggctcaggacagggaggagttgaggccactgttcagggggctggtggccgtctccactccctaggcaagttctctgaggcagaagggggttccctgttcccagagtctgcagccatcagcaaggaggaccaggaacccggcgactgaggtgcttccaggtggggacaagcccctcttggtctcagccacagcaccccttattccagctgccctgcccaacctgctcaccccacatgaccttctgtgtattcagcaaacactcactaggtgacagcggccaccaggctctgtgctgggggacgatactggccctggcctcgaccagcttagaggtttctcacacctctgttcccagggccccgctcagggcccagcagagagtccgtaggcttgaacatgtgttgagtgcatgaaaaataaatgctgttcatgtgtgtaaaaaaaaaaac

SEQ ID NO: 383240 - DNA, 3304 bp, Homo sapiens
acgcggaggcgggcgcgcgccccgcaggggagggggcggagagcgcgagaaggagggaggaggcgtccccgtgcgggagcccggctgaccgcgccagacccagacagagcatcgcggctttggctgcaacaggcggtgggctcggctcgggggcggaggcggcgaaagggcggggagcgcgaggaggagcgacctggcctcaccgctgccgcctcttccccgccgcatggacgagcgcctcagccttctgcgctcgccgccgccgccctcagcccgccaccgcgcccaccctcctcagcgcccagcgagcagcggcggtgcccacacgctggtgaaccacggctacgcggagcccgccgcaggccgcgagctgccgcccgacatgaccgtggtgcccggggaccacctgctggagccggaggtggccgatggtggaggggccccgcctcaaggcggctgtggcggcggcggctgcgaccgctacgagccgctgccgccctcactgccggccgcgggcgagcaggactgctgcggggagcgcgtggtcatcaacatctccgggctgcgcttcgagacgcagctgaagaccctttgccagttccccgagacgctgctgggcgaccccaagcggcgcatgaggtacttcgacccgctccgcaacgagtacttcttcgaccgcaaccggcccagcttcgacgccatcctctactactatcagtccgggggccgcatccgccggccggtcaacgtgcccatcgacattttctccgaggagatccgcttctaccagctgggcgaggaggccatggagaagttccgcgaggacgagggcttcctgcgggaggaggagcggcccttgccccgccgcgacttccagcgccaggtgtggctgctcttcgagtaccccgagagctccgggccggcccggggcatcgccatcgtgtccgtgctggtcatcctcatctccattgtcatcttctgcctggagacgctgccggagttccgcgacgagaaggactaccccgcctcgacgtcgcaggactcattcgaagcagccggcaacagcacgtcggggtcccgcgcaggagcctccagcttctccgatcccttcttcgtggtggagacgctgtgcatcatctggttctccttcgaactgctggtgcggttcttcgcttgtcctagcaaagccaccttctcgcgaaacatcatgaacctgatcgacattgtggccatcattccttattttatcactctgggtaccgagctggccgaacgacagggcaatggacagcaggccatgtctctggccatcctgagggtcatccgcctggtaagggtcttccgcatcttcaagctgtcgcgccactccaaggggctgcagatcctcgggcaaacgctgaaggcgtccatgcgggagctgggattgctcatcttcttcctctttattggggtcatccttttctccagcgcggtctactttgccgaggcagacgaccccacttcaggtttcagcagcatcccggatgccttctggtgggcagtggtaaccatgacaacagtgggttacggcgatatgcacccagtgaccatagggggcaagattgtgggatctctctgtgccatcgccggtgtcttgaccatcgcattgccagttcccgtgattgtttccaacttcaattacttctaccaccgggagacagaaggggaagagcaatcccagtacatgcacgtgggaagttgccagcacctctcctcttcagccgaggagctccgaaaagcaaggagtaactcgactctgagtaagtcggagtatatggtgatcgaagaggggggtatgaaccatagcgctttcccccagacccctttcaaaacgggcaattccactgccacctgcaccacgaacaataatcccaactcttgtgtcaacatcaaaaagatattcaccgatgtttaatatgtgatacaagtgacatgctgtgctcagtattgtgtggaacgtgcccccttggtctgcctatgcccttgttttatacatttccagaccattcatcaaggaaaggacctgaagaagtggaaagcacacttcattctccctctccctgctgcttcatactgaaacaggtgcctgttttgcaagtgggctgcattctctcagctctccttttccctcttaccctctctctctgaacattgtaaacaacagacttacgttaaacttcatttctagtacacgccctatttaaaaaagagcagtacatcctgggaggaaatgaaactaaagaacagttagagtaactgtttaacctcagaattttaaaggcagttgtttctttcctaagcacatcaattcgtagtaaatgatgcttcggtttgatggacctttcaacgttatttattgaatatgtatttcggtgtgcctaccctgtagatatgtggatgaagagtctaactagaataatgacttgtaaacccaccatgagttatttggtttttgacttaaattcctatttgaatcccctttcccggaattttaagtgtctctacaactttgaataaagggaaatgcccccaagatgtcctgatctgacatattagtttaattctttcgggcttgctaagcatttctaaagcattagactaacagattcctgtgaagttctgtgcatatgtcccagccccaacaactatcaaagtctagaaacagatgttttcagtgttgctgagagaaacaaaaaatttcctaatgcatctgagagataagcttcggcagtatcacaagaagattaaagtggcagacaccccttccagcggaagttactaattcggacctgactgatgcagtttccatagcaacccatgtttcctgggaaacccgaaaaaggttgtcatggcatctcttgcacagtaacctttccagatggttcctacttaaatgatttcataaggaaaaccactgtttgaataagccgcacaaaaaataaagttaagtctgagactctaaggaggtgaaatgaatcccaaatgcattttttaactatgaaaatcattatgtcattccataatgactgaatcaaggaggaaaatatggtgtttggaatgttagatattaaccacaataaggcatgatctggattaaatgccatttattaggcaataatttttaaagatgcttcccaagaactttcaagccaacaaatgaaatttaaaagcaaatgtaaaagtgttcctgtacataagcaaatgagagattcgatcagtgtgcctgaaaccttactacaagggaccttcaggccttttctctttt

SEQ ID NO: 383241 - DNA, 530 bp, Homo sapiens
gatgcagtttccatagcaacccatgtttcctgggaaacccgaaaaaggttgtcatggcatctcttgctctctagccccacctcccagcccctgccgtttccacagtaacctttccagatggttcctacttaaatgatttcataaggaaaaccactgtttgaataagccgcacaaaaaataaagttaagtctgagactctaaggaggtgaaatgaatcccaaatgcattttttaactatgaaaatcattatgtcattccataatgactgaatcaaggaggaaaatatggtgtttggaatgttagatattaaccacaataaggcatgatctggattaaatgccatttattaggcaataatttttaaagatgcttctctacagttttctttctccaagaactttcaagccaacaaatgaaatttaaaagcaaatgtaaaagtgttcctgtacataagcaaatgagagattcgatcagtgtgcctgaaaccttactacaagggaccttcaggccttttctcttttaaaaaaaaa

SEQ ID NO: 383242 - DNA, 403 bp, Homo sapiens
cctggcctcggataaattcccttggtgtagccgtgaaatgacctatatacccagaaaccagttaattattgccctaggatcttcaagctaaatatgaatagacaaaaacagtcctcctatagaggaatggttcacagagtggatggaagtcccaggggtatgatatgggcagggaactgtcatgtgtattgaggtaaggtacaaaaagctgctttcgcttcagacacaagggacattttattcctaggagaacaccctttgtaaatgtggatgttcacagttatgagtggggtatgagcctgcagtgtatgttttgcagctctcggagctctggcggtccaccaggaaatacctgcagcctgacaacctttccaaggctgaggctgtcagaaacttcctggcc

SEQ ID NO: 383243 - DNA, 393 bp, Homo sapiens
attccactgtgtgcctcagtcaagcaaccaatgcaaaactttgtaaaactgtaggttgctttcttggacccaagaataaagccagtctcacccaagtcttcttcaatgtatggtcatgcatatatctaaggtatatgatttttcaggcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtaaaatctccaagaatatttgcaacatttacag

SEQ ID NO: 383244 - DNA, 3939 bp, Homo sapiens
gttctgaagagggtcactccctcactggctgccattgaaagagtccacttctcagtgactcctagctgggcactggatgcagttgaggattgctggtcaatatgattcttcttgctgtgctttttctctgcttcatttcctcatattcagcttctgttaaaggtcacacaactggtctctcattaaataatgaccggctgtacaagctcacgtactccactgaagttcttcttgatcggggcaaaggaaaactgcaagacagcgtgggctaccgcatttcctccaacgtggatgtggccttactatggaggaatcctgatggtgatgatgaccagttgatccaaataacgatgaaggatgtaaatgttgaaaatgtgaatcagcagagaggagagaagagcatcttcaaaggaaaaagcccatctaaaataatgggaaaggaaaacttggaagctctgcaaagacctacgctccttcatctaatccatggaaaggtcaaagagttctactcatatcaaaatgaggcagtggccatagaaaatatcaagagaggtctggctagcctatttcagacacagttaagctctggaaccaccaatgaggtagatatctctggaaattgtaaagtgacctaccaggctcatcaagacaaagtgatcaaaattaaggccttggattcatgcaaaatagcgaggtctggatttacgaccccaaatcaggtcttgggtgtcagttcaaaagctacatctgtcaccacctataagatagaagacagctttgttatagctgtgcttgctgaagaaacacacaattttggactgaatttcctacaaaccattaaggggaaaatagtatcgaagcagaaattagagctgaagacaaccgaagcaggcccaagattgatgtctggaaagcaggctgcagccataatcaaagcagttgattcaaagtacacggccattcccattgtggggcaggtcttccagagccactgtaaaggatgtccttctctctcggagctctggcggtccaccaggaaatacctgcagcctgacaacctttccaaggctgaggctgtcagaaacttcctggccttcattcagcacctcaggactgcgaagaaagaagagatccttcaaatactaaagatggaaaataaggaagtattacctcagctggtggatgctgtcacctctgctcagacctcagactcattagaagccattttggactttttggatttcaaaagtgacagcagcattatcctccaggagaggtttctctatgcctgtggatttgcttctcatcccaatgaagaactcctgagagccctcattagtaagttcaaaggttctattggtagcagtgacatcagagaaactgttatgatcatcactgggacacttgtcagaaagttgtgtcagaatgaaggctgcaaactcaaagcagtagtggaagctaagaagttaatcctgggaggacttgaaaaagcagagaaaaaagaggacaccaggatgtatctgctggctttgaagaatgccctgcttccagaaggcatcccaagtcttctgaagtatgcagaagcaggagaagggcccatcagccacctggctaccactgctctccagagatatgatctccctttcataactgatgaggtgaagaagaccttaaacagaatataccaccaaaaccgtaaagttcatgaaaagactgtgcgcactgctgcagctgctatcattttaaataacaatccatcctacatggacgtcaagaacatcctgctgtctattggggagcttccccaagaaatgaataaatacatgctcgccattgttcaagacatcctacgttttgaaatgcctgcaagcaaaattgtccgtcgagttctgaaggaaatggtcgctcacaattatgaccgtttctccaggagtggatcttcttctgcctacactggctacatagaacgtagtccccgttcggcatctacttacagcctagacattctctactcgggttctggcattctaaggagaagtaacctgaacatctttcagtacattgggaaggctggtcttcacggtagccaggtggttattgaagcccaaggactggaagccttaatcgcagccacccctgacgagggggaggagaaccttgactcctatgctggtatgtcagccatcctctttgatgttcagctcagacctgtcacctttttcaacggatacagtgatttgatgtccaaaatgctgtcagcatctggcgaccctatcagtgtggtgaaaggacttattctgctaatagatcattctcaggaacttcagttacaatctggactaaaagccaatatagaggtccagggtggtctagctattgatatttcaggtgcaatggagtttagcttgtggtatcgtgagtctaaaacccgagtgaaaaatagggtgactgtggtaataaccactgacatcacagtggactcctcttttgtgaaagctggcctggaaaccagtacagaaacagaagcaggcttggagtttatctccacagtgcagttttctcagtacccattcttagtttgcatgcagatggacaaggatgaagctccattcaggcaatttgagaaaaagtacgaaaggctgtccacaggcagaggttatgtctctcagaaaagaaaagaaagcgtattagcaggatgtgaattcccgctccatcaagagaactcagagatgtgcaaagtggtgtttgcccctcagccggatagtacttccagcggatggttttgaaactgacctgtgatattttacttgaatttgtctccccgaaagggacacaatgtggcatgactaagtacttgctctctgagagcacagcgtttacatatttacctgtatttaagatttttgtaaaaagctacaaaaaactgcagtttgatcaaatttgggtatatgcagtatgctacccacagcgtcattttgaatcatcatgtgacgctttcaacaacgttcttagtttacttatacctctctcaaatctcatttggtacagtcagaatagttattctctaagaggaaactagtgtttgttaaaaacaaaaataaaaacaaaaccacacaaggagaacccaattttgtttcaacaatttttgatcaatgtatatgaagctcttgataggacttccttaagcatgacgggaaaaccaaacacgttccctaatcaggaaaaaaaaaaaaaaaaaaaagtaagacacaaacaaaccattttttttctctttttttggagttgggggcccagggagaagggacaagacttttaaaagacttgttagccaacttcaagaattaatatttatgtctctgttattgttagttttaagccttaaggtagaaggcacatagaaataacatctcatctttctgctgaccattttagtgaggttgttccaaagacattcaggtctctacctccagccctgcaaaaatattggacctagcacagaggaatcaggaaaattaatttcagaaactccatttgatttttcttttgctgtgtctttttgagactgtaatatggtacactgtcctctaagggacatcctcattttatctcacctttttgggggtgagagctctagttcatttaactgtactctgcacaatagctaggatgactaagagaacattgcttcaagaaactggtggatttggatttccaaaatatgaaataaggaaaaaaatgtttttatttgtatgaattaaaagatccatgttgaacatttgcaaatatttattaataaacagatgtggtgataaacccaaaacaaatgacaggtgcttattttccactaaacacagacacatgaaatgaaagtttagctagcccactatttgttgtaaattgaaaacgaagtgtgataaaataaatatgtagaaatcaaaa

SEQ ID NO: 383245 - DNA, 968 bp, Homo sapiens
  misc_feature (769)..(769): n is a, c, g, or t
  misc_feature (774)..(774): n is a, c, g, or t
  misc_feature (776)..(776): n is a, c, g, or t
  misc_feature (783)..(784): n is a, c, g, or t
  misc_feature (793)..(793): n is a, c, g, or t
  misc_feature (808)..(808): n is a, c, g, or t
  misc_feature (816)..(816): n is a, c, g, or t
  misc_feature (819)..(819): n is a, c, g, or t
  misc_feature (822)..(822): n is a, c, g, or t
  misc_feature (826)..(826): n is a, c, g, or t
  misc_feature (840)..(840): n is a, c, g, or t
  misc_feature (849)..(849): n is a, c, g, or t
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaaatggagcagatatngttgngnacggttnnaattctgcntgtggtattattatntctggatnccnaanaagngggtatcagtgcanataacttgnaatttgttagtgagtgaccggtttgaccctttttacttaagaggtgttcgccggggctcgggaagggatgacgaaagttttgagcaggcactgtttcaggagaagggtgtgtcccacat

SEQ ID NO: 383246 - DNA, 749 bp, Homo sapiens
aggcaaaggggaagctgttgattgcaaggtgtcagcccagaaactgctgagcttactgaaaaggacgagttcaagtctgaagcccacgtggacttctatgacaaataagcccatgtttttggcttcttgaacctttttgcccccactgttagacataccccagagccctgtggctccccacaccctgccataggggcagtcctgccttacacatagaagcattcatgcctgctgccctgccctcaggcacagccagctgtgagctcacaggtcattggccttaccagttgtcaggagtctgtgctgtgcaccctgggttataaggaggcttaggagagaggttatgggtattggtgtctctatccccaggaatagaacttaaggggtgggaagaacaggaacctcgtgccgaattcggcacgaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383247 - DNA, 287 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcacttgggcgacagagtgagacttcatctc

SEQ ID NO: 383248 - DNA, 3598 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaaaaaaaaggggggcgcacaaaataccccaagggcccagttccgtacccactttttcaagggctaaggagggtataaagagagaggccggaacagcgcgggaacgtctggcttggaggccctctggggatggacccgaaccggaaaaagataggccttccgaacattaaag

SEQ ID NO: 383249 - DNA, 3524 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaataaaaaaaaagagaaaaacaagaggggaaaggaaaaaaaaaatattgtggggggtctgaaatttaaaaattgggggggccaagagagaaagaagtc

SEQ ID NO: 383250 - DNA, 3502 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaatggagtttcgctcttgtttcccaggctggaatgcaatagcacgatctcagctcactgcaatctgcacctcccagagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383251 - DNA, 3046 bp, Homo sapiens
ggcggcaggggccccaggtgggggtcgggggcgcctgcgcgggttgcctccggcagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383252 - DNA, 2926 bp, Homo sapiens
agcactgtgcgacatttagaactctgattaacaaacaaggtggtcacaaattttcctggcttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383253 - DNA, 2984 bp, Homo sapiens
gcctgctgaagtagagtcttagggtgaccccaggggacgtaatgtttccgagaagaaggacagaaagaagactgggagacaccggaactcgaaagaaaatcgatggtactgccttttaaggtctattacttaaacataagtatggctctggttcttaccgcctttaccgtatccttcatgggaagttgatactgatcggaaactgacacagagccttctcacctacactaagggggcctagcatacagaaaggctgtacctggaggaaggaagtgcggagccagcctgagttgggagaagagctccagagaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383254 - DNA, 2537 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383255 - DNA, 1654 bp, Homo sapiens
  misc_feature (1007)..(1008): n is a, c, g, or t
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaatggagcagcatatgtttggggcgtatgaatctgactgggtactatatactctgggttccagagagtcggtatcagtcagcagattaactgggatttgtgggggttgtccgcgtttggccgttccttgagacggtgcggagaggcccggaaggatcgccgacggttgtgtgccgcactcggttcagggcgggggtggtgcccccctttctctctcctctcgctgtctcgcttgatttccggtgaatgagcaatnngcaaggacagacaacagacaaagacacgaacacaaaacacacacagccacgacaaggagcaccagggagaagacacaaaacacacaaagagccaaagacgagagcagacacagaacagcaacggacacaacaacgagaagcaaccaatacagacgacgaacagacggagagagtcaaggaaaagggcagaggcgaacggcacaggaaagaagagaagaaggcgaagcagaaaagagagacgagacgaagatggaggagcgagaaggggaaaacaggaagcgggaagagaaggagagcaaggaagaacgcgctaagaagaggggaggagaggagcgacgaataaagagcaggaggagacaggaggaacaagaagaagggagaaaggacagcagagaagaagaagaccgagacagaagagcaagggaagatgaaggacgactactcagggcagcaagaggcaaaaagaacagaaaggaagcaagaagaagagcggagacgcagacaacgaagaacaacgagacgacggaaagagcggacaagaaggagaaggaaagagaagaagcggaagacacgacacgaaaaacacaaggagaaaaaagaacagagaaagagagcaaaccagacaagaaaacaaagaaggaccaag

SEQ ID NO: 383256 - DNA, 3427 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383257 - DNA, 1896 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtcctt

SEQ ID NO: 383258 - DNA, 3706 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcagaaacttttctgttgccctgttttttaagtagcctacttgaccaaatactacatgtctgaagtttaaaatcaatacaacaatgtgtatttatgagtttggagttagacagaagtttaaaagtgttaggtcccaacctttattatagactagactcttaaaacattggttgaggatgatcaaactcaaataagtttccttatttcattcatggttatttctattaagtagaaaaaaatttataaccttgatcattttctttattttttttaatttaggatct

SEQ ID NO: 383259 - DNA, 3368 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383260 - DNA, 3198 bp, Homo sapiens
acaacgaccgtcactacccagggccggagcggcaactccgcagcggagctctgcctgcccgctgcgttcccccaagagactagaccccacaaactcctcctccaccgcggtcccaactcgagtccccccgccgtctccgagcactcggagggcgcccctctgggacgggaccgacgcctcggaccgggctgcgccgcgggagttcgagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383261 - DNA, 3340 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcagcatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383262 - DNA, 2432 bp, Homo sapiens
tagtctttccattcttaacactgtgaactttttctctcagggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtgcatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatgagttgagtccttaagaaaatgattccagttactcattttgcatatttgctattttaacattattggaccctgcatttatagtcctttgatttcttccctctccctggtgtctcccccaagaccccaaataaagcaatacactgttaacactgtgggtttatatactaattctataccccagatggggaatgggggagatggtccctgggcttaatattctttaaagggcatgggaatttagcctctcttttattgtaatgtgctcttttggaaaatagttggttagcagggaagacccagagttgtagattgagattagggtgtactggctgaactgtggaaaacatacaattctgtgttcctcagtaaatgagattagcgtctaatgagtagcacccctttactaacttagtagtagtataaaatcatttttatttagttaattaccagagagatttagcataattttgttctggattcagtaaatcaagtcagcttggatcattcaccttaacttttcctttagcagccatttccactagtttccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccatggcattcataggatgaaatgaatgactgcccagaatgagaatttgtccagattattcagataaacatcataaagcagaatacattataaataagtagaatatgaataaatagaataataaaattccaaaatactcaatgggaaatgactagtaatataggctttcaagagttggtaccttttagctatatttgcagattctctgggattttaaggaactgagaaaacagcaaagttgactaaattttatatttcttgtcctctaaatattttgataatttctggattgatgcagtgatgtttttgttccttccgtatttataaatgaaacacctttttttagtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttgaaatgtatttctgtaccacaatttacgcttcaataaaagtttaattgtctagtgacattcaga

SEQ ID NO: 383263 - DNA, 695 bp, Homo sapiens
gagcgggcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatccgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaaggtgggtccccggggcgctcgctgacatccgggcctgggggctgtcgccgccgccgaggcaccagccacgggtggagcccgagttccctcagctttcagttgggggcaagtctgcggcctggggtcgcttcggcggccttggaaggtgcgcggtttgggggagagcggccatgtccacgcgggccggagccggcttctcccgccgtggttgccgcgcctggcattgccctgggggaggggaggaggccggcgcggccgc

SEQ ID NO: 383264 - DNA, 280 bp, Homo sapiens
gctatctagtttatcttagggtaatttgggaatacccctagaaggccactgtataaacctgcatgtagtaaattgaggtctatgtttctgtaatggatggaaagaaaagcaacaaaacaaataactaattttgttaaatctgattttaattcttctttttaaaaaaagcaaatggcatgatattttggcagactttttgacagcacccacatttgatttgatgagatgtgtgctcctatttgagttatgtccaaagggcagacagatggaagggttttac

SEQ ID NO: 383265 - DNA, 278 bp, Homo sapiens
tgctccaccctaacatcgtatattcaagaccagaggcagggagacaattaagaaggtgttggtgagagatgacggtggctccaactgatgtcatggtgtggatggatttaagaggaagaatcagcaaagttctggcatgtttaaatgactccagctttccatacctttcctttgcagcacctggtctatcatttcaactgctccctctcacctgcacatcgcaggtgcctgacaaagccctagtcttcatcaatcccaatgcatatacttgggtactg

SEQ ID NO: 383266 - DNA, 1716 bp, Homo sapiens
  misc_feature (250)..(250): n is a, c, g, or t
  misc_feature (718)..(718): n is a, c, g, or t
cactagtgaactttgtcatcactattattattggtgaatttcatcggtctattagcataggagaattgcctatcattttgtgtatctgtggaaagaccaggagaaggcattattttctggtagagcaagaggtggatttactttaggagattattcagttgtgaggtgccatctgtgcattttctgtaaatctttctgaagtgttgggggaaaaagtgaatgggtactcaagtcagggaagcgtaagccntacgacactcaggtaagaaacagatttttctcttaatgccctattcttataggaaaattcacttggcaataagaattctgcctacacagccttgcagatctgatgcaattatcaaagccatgttttgcaaaatgaaactgatgccaagctcgtgtcaagtggattatagattgtagaactgcagtcactggccattagctgagtgtctttgttttctactctaaaatcttgaattccttattggttctgcttctgatgtgctgcgtggcactcttcctgtggaaatggtcttgcaggagatgattttcctttctagctcaagcttctcaagtgcccaaccccggatcagcaaccccagggcttgtcctgttcgggaacacgatggagttcagttgctctttgatccccttcttccacctcaagacactctctcttctccaggtatcacagtgtcctctttcagtcttntatttggaatcatccctttctcccattttccctgttaaacatcctcccttaggtgcctttggaaaaagatttgatgaactgaagaacagggaggtattggcccattgacttcatgttttactactgcttacgtgtttgtctgttgactgggaacggtttctctagttcaacaatgaacccaataggtgggttttcacactggctaggctttggaggattgcatttttttagacataatgtgtggggcttagggagggcagccaggcagtgtgggatgcaatctcttctctgaagcagctggttctcgctataagctcagccacgtacattccactcccaagtttccttggcgctaaaactgcttggaatagcctaagcctacggaagcaaagatgacttatttaaacagcttcatggttcctattacctttctttttctgtatcttctaactttccatgtcttcctgaaggacatgttccttttgtcactgatatttccagtcaaatttagtgatcttaaatttgatcgagagtgaggtgtaactcctaggagaaattctgagtgtttataactaggtttccgaaataatgtgtttggggaagtctctgagatgttattaattttgactttttattggtaagatctctaaaaatgaaagagtattttcacaacagttcatgtagatataatttcttggcatgtggttttggcaatcagagttttatttatttatttttttccctgtacctgcttggttaggggagactttaaaatcttgtcctggcccaattgagaggagttatctaggaactgaaaaataggtaggccctggctgctacctcctttctgggctaagacccgtaacctgggtttcttcatttgaagtgtgagaatgcacgtgtaatcccagcactttgggaggccgaggcaggtggatcacctcaggtcaggagttcgagaccagcctggccaacatggtgaaacccctgtctctact

SEQ ID NO: 383267 - DNA, 906 bp, Homo sapiens
tagaaatttgtctgcaaattttttcctcattcagacagagagctggggtccaggaaacactgggttgatatgataacttgattaagtctggggacagatgacacgggagcaccaactcgactcaaaggaacctgtgctctcctctttaacctctccttgggagcctacaaattatatctattaatgcatcagccccgggaactgcacaaagacattgtctgcctaaatgtatgtcagtcatttgcaggggcctttgtggaattcccaccacattttcatgtctcttcgctatttgaaaaaataaaatgtaaactgatgggctagacaaaggctcacagtctacctcctctcgttaaaatcgctttgaaggcagaagtcaagttcatcagcaaaagtgttcaagaaattcttgaaatgggccctgggcagctggagcatatccaggggagagaaactacaaggaagaagggtttggaaactgcatccagtgaagcatggatggaaaacccagggatttgcctggagaagagaaaacacagagaggacttgggagctgaagaagtgccaacgggaagaaggatgagagtttgctgtgggtcccgggacagagcccagggagagacaggcgttcgccaagtgccagcaaagtgactggatgaaaaatgggccacgtgctggggccgcccctgcggatgtgaggaaatcagtagcgtggccacagctgcacaaatcacagctgcctctcctggtgtctgatccaggagacagccggccattgagaggctggtaaacctcagctccaaataacgtgagtttttaaaatgtgagggttaatttaacatacagtaagttttgtatccaccaccccagtcaagatatagaaaatttctaccacaatgcaaggta

SEQ ID NO: 383268 - DNA, 870 bp, Homo sapiens
  misc_feature (821)..(821): n is a, c, g, or t
tagaaatttgtctgcaaattttttcctcattcagacagagagctggggtccaggaaacactgggttgatatgataacttgattaagtctggggacagatgacacgggagcaccaactcgactcaaaggaacctgtgctctcctctttaacctctccttgggagcctacaaattatatctattaatgcatcagccccgggaactgcacaaagacattgtctgcctaaatgtatgtcagtcatttgcaggggcctttgtggaattcccaccacattttcatgtctcttcgctatttgaaaaaataaaatgtaaactgatgggctagacaaaggctcacagtctacctcctctcgttaaaatcgctttgaaggcagaagtcaagttcatcagcaaaagtgttcaagaaattcttgaaatgggccctgggcagctggagcatatccaggggagagaaactacaaggaagaagggtttggaaactgcatccagtgaagcatggatggaaaacccagggatttgcctggagaagagaaaacacagagaggacttgggagctgaagaagtgccaacgggaagaaggatgagagtttgctgtgggtcccgggacagagcccagggagagacaggcgttcgccaagtgccagcaaagtgactggatgaaaaatgggccacgtgctggggccgcccctgcggatgtgaggaaatcagtagcgtggccacagctgcacaaatcacagctgcctctcctggtgtctgatccaggagacagccggccattgagaggctggtaaacctcagctccaaataaccctggaaacattngcaccgaaccaatatttagaaaggagggacttttgcagcggaatttaaa

SEQ ID NO: 383269 - DNA, 493 bp, Homo sapiens
gccccttgtgaaattgcttcactctccctcccacctgcaaccctctcaggacttacgctccacgacctctgaaatcattttccttttcctggaaatgagcccacatgccccccaggcctctgtaagttaacttcctcagtttccctctttcctaggaactttttcctccctctctgccttcaggctagttcccaaccagaactattcaaactagagttcaattcttttggtgtatccccatgatactttctttgtgcctttgccatagcacttaccactctcccattgaactgcatttcctgtgttatatggcaaaattaaaataatacaaaaaattagccaagcgtgatggtgcatgcctgtaatcccagctactcgggaggctgaggtaggagaatcgcttgaacccaggaggcggaggttgcagtgagccaagattgcgtcattgcactccagcttgggcaacaacacaaaactctgtccaaaaaaaaaa

SEQ ID NO: 383270 - DNA, 920 bp, Homo sapiens
agcagtcgataaggaaaaagattgacaaaagaaactataagcaagcatgctgttttgagtcgccggaggatagagacggcccaagaagaatttcaagagaactgctaatgagaaaccttccgtggtgagacttgaactgacaagctattcccccaggctcctcgggaacatctcataactaatcgggacattccatcaagaccacatgcacagggccacagcctagacagcagagcatccaaaccgccaaagaaaatgttgaggctgcaccaataagggactttgtgcaatgcctcttttattgaaaaaatctatttaaatgaaatctttctaggacattatgtcaaaactgcaactggaaacgtctgcttttctcacctggaagaattgcccctattaaaccatagtaactataaacagtaattatgtatagctgtgcataagcatgcaagtgtgtatctataggtaaccatttatttaacaatatatattaagcaccttgtgtgtaccaagtactgttttttgttgttgttagtttgtttttgagatagaggctcactgtgtcgcccaatctgaagtacagtggtacaatcacatttcactgcagccttgacctctctggctcaggtgatcctcccacctcagcctcccgagtagctgggaccgcaggcctgtgtcaccacacctggctaatttttgtagtatttgtagaaatggggtttcgccatgttgcccaggctggtctcgaactcatgggcacaagcaatcctcccaccttggcctcccaaagtgctgggattataggcatgagccaccatgccaggcccaggtactgttataagtgcttgtgaatatgtcagcaaataaacaaatgtccctaccattgtagtgctaacattttagaagggaaagtcagaaaa

SEQ ID NO: 383271 - DNA, 381 bp, Homo sapiens
tgctcctacttctttttttctttcccactattgaagtctgtgatctggaaaaaatgtgtgctccattcttcacgtgaagtagggtctcagctgtattgactgtacaattctggtatttgtgtggagagctttttagccaaggtggctggtgcgggggttaccctaagtacttcagcttttgggaatcatcatttgctttaattgtcagctaaaatggctcataactccatgccatttactgtgggaagtctatttactaatcaagatttctaaggctctctcggtgtgacgaatgcattttaaggatttcttctgatgtcatcacacacctggctcacctctagtggttgctaatctgctttctggccactttgccctcca

SEQ ID NO: 383272 - DNA, 772 bp, Homo sapiens
gcgcgggggtgaggcggccctcgcgtccgcccgccccgccacagattgcctccgaagtggcctggccgtggagcgccggcgaaaaccgaactcccgcccggctcccggagtcgggagcctgccggggtctcgccctcaggacccccagggagcggccgggcgccgcctatcaccctgacccaccgcaccttgagagcgctttcactgcgcctcttttttctcctctaccaatctggaaaggaagtgagtgtcatttcagacattgagaaacattattcaacactggttacccagtgactcagctcactccttaaccgcaggcttccacatcctgctgtcccttaaaattgccttcacaaagggcagccaagagcccagctttggagagatacccagctccaactacccactggcaggcaatacgcagggcagctagatggcagagagaccttggaccttcggaccttcggggagcggttttcccttcggtgatatctaccttgctatgttcgtgatatctaccttgctacgttattttgaagattaagtgagctcttactttaccgagtaaagtgctttgcttagcacactgtctggaacttaaatgagaagtactgacaatataacttacaaaaatcctaaactattgcctgagaaaaagagggagacaggacagctaagcaaaagacgagaatagaaaacacccacagcgtgaaaaactgtaaaattaactcaatagtattctcttttacttgttacaacaacgcaagac

SEQ ID NO: 383273 - DNA, 252 bp, Homo sapiens
gaaataacaaagatttatttcttgtgcaacacattcatctgtggtaggtgtataggtggggtgttttattcttccccaggtaacttataccctgggatgctggtgtttccactagctggagtgtcatagatcactgtggccagaggaaattggaacttgggggatcatgttctacttctggcttttgcttacagttcattggccaaagcaagttacatggccactgctcacttccaggcgctgaggaagatc

SEQ ID NO: 383274 - DNA, 441 bp, Homo sapiens
tatgcagtagcaaaaatcaatgctggttgctttacacttacattctacttctagagaccccagaatacagactgattggatagctctggaaaaaatcctggggatgagtttgaattgactggatttgggttcaaagataatccatgaacaatccactgttaccagggtgattgtgttctctgagcaacacatcctgtaatagatgtcacccttggtgctggaagttggggtcagactcctgagccacttggactgagactggggatgggacattttccaaaatattctgggaagaaagagtgtctactataaacctatagacagccaagtcagagtttcagccagttccgtgtgatcttagaacatcaatgtgaaaatatggtcatccattcattcaacaaatatttagacatttttcaatgctatagaatgcaatgataa

SEQ ID NO: 383275 - DNA, 427 bp, Homo sapiens
ccaaatcttgctctgtcacccaggctggagtgcaatggtgtgatcttggctcactgcaacctctgcctcccgggttcgagctattttcctgcttcagcttcccgagtagctgggactacaggcatgcagcaccatgcccggctattttttttttttttttttttttgtatttttagcagagacagaattttgccatgttggccaggctggtctcaaactcctgacctcaagtgatccgcccgcctcggcctcccaaagtgctgggattacaggtgtgagccatcaatgcctggcccactaactcacttctaaatgatcttgttctctttgaacagaaataaaggatattatgatcttaccactttataaattagaatgatgaaattgagaaaaactagagatgactaagatgaagacagacatgaaa

SEQ ID NO: 383276 - DNA, 1207 bp, Homo sapiens
tgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcat

SEQ ID NO: 383277 - DNA, 129 bp, Homo sapiens
tttggagaaaacagacttttataaatatattgattcactcatctttccatttaatcattaattagcctaaatcatttaattgctaaatcatataatatactagccccctccaaaaaatgataaataaaa

SEQ ID NO: 383278 - DNA, 635 bp, Homo sapiens
ccaccacacccggctagtttctacatctttaaattgagagaatggaaatacgtgatctgtagtttcatttccggctctagctgattctgacttacctatcaaatgagattggcctgggagttttggctttgaagattttgcttctgttgtaagtcactgggaggcttgcccagtgcccagcttaatcttgaattcctatttctccgttctctcatttagtaagtcctttagaaccttcctcttgtgctgttgcttgggctaacatctcccctcccaccctctaccactagaattccttgtatatacacagcagctagattagtctcactttgcctctctatagaaataaactgaggtagatctccattgtctcccgaagaaaggccaaactcattagctgggtattcaggatcgcctgtcaatctcagctcacattactccccttcacataatctaaagaatagttaaactgaacctaatatcctcctgcacctggtcatgccctgcctctctccattgtcactcggtcacaattaccatctcacgaaatctcccaggcttccacagcagaagtaacccttttcttctcagctcccatagcgtgttttctgtacctgctagtactgattgatttg

SEQ ID NO: 383279 - DNA, 318 bp, Homo sapiens
tttagaagctacagaaagctcttatggacaaaggcctgctcatccttaaagacttcccttgaaaagtcttttcagatgttcctagataaagtatcctcccatagccccttagtcatatttcagaacagcatttgtcacttggtcttgtaatgatgagttaatacacttgtttataccatccaactgtgaactcctagactgaggaatatctttggactgaggacatatccccacatgggagcactggggagaatacgtaggcatttcccattgagcactttttgaaataagtaaataaaagggtcacagaaaattgaa

SEQ ID NO: 383280 - DNA, 440 bp, Homo sapiens
acaggcacttctcaaaagaagacgtacatgcagctgacaaacatgaaaaaaaagctcaacatcactatcattagataaatgcaaatcaaaaccacaatgagatactgtctcacatcagtcacaatggcaattataaaaaagtaaaaaagaagccatttgcagcagctcaaagtgctgtaatcccaaacctttgggaggctgaggtgggtggatcacttgaggtcaggagttggagaccagcccggccaacatggcgaaacgaacccctgtctctactaaaaatacaaaaaattagctggatgtggtggtgcatgcctataatccccagctacttgggaggctgaggcatgagaattggttgaaccggaggcagaggttgcagtgagtcaaggtcatgccactgcacttcagcctgggcaacagtgaaactgtgtctcaaa

SEQ ID NO: 383281 - DNA, 329 bp, Homo sapiens
cacgtggtgatatgttaaagggtcacaggagtcaaatgaaaaagttcccaatgtccaaagctggaactacaaaatagagcagtattggattataaaccaaaatttaaaataaatatccatgagttggacacacagtggggaacaacacacactggggcctgtggtggagggagcaagccggggagggagagcatcaggaagaacagctaatggatgctgggcttaatacctgggtgatgggttggtctatgtagcaaaccaccatagcacacatttacccatgaaacaaacctgcacatcctgcacatgtaccccagaacttaaaagtt

SEQ ID NO: 383282 - DNA, 577 bp, Homo sapiens
gtctgagattcttgagcctttcagtcagtgtttgatctggccattcaggaaggcttattataaactaatgtataactttgttcacaatctcgcaaagtttccactgtctgaaaatcctagtgcatgagactcctacatcgttattaatggcatatccttaataaaagtttggcttttgatttttaatgggttttcaggagataacttcccaaagaggcattagatagtttaacagagcctgtcattaatgtgacctgtgagaagacttggctagaggtggtgaaatatctttcctctatccctcccaaagacaagaaaaacctatggatgaggatgaaaatttggcacaagagcaatcattggcggaagttgaatctgaaactgttgacaccaattcaagttaatgctgctagaggctgatcctcaggaagctttcttgactccagaggttattatcataagtgatgatgaagacaattaggaggctgtgggactggaaacaaatacagcaataagaaacaggagcaaaatttttagaacaagattaaaacctccctaagaaggtaattaaaattgg

SEQ ID NO: 383283 - DNA, 675 bp, Homo sapiens
cttgtccttggagcaaaaataacttttttttttttgacagaatctcgctctgttgcccaggctggagtgcagtggcgtgatttcagtgcaatgcaacctccgcctcccgagttcaagcgattctcctgcctcagcctcccgagtagctgggattacaggaacgtgccaccatgttcttgagttgtaattattccactccctaaatatatcaccttgagtgagtcacttaacctctctcaatcttaatttctgataggaattaataatcttttcatataacatagtgtcattgtgagactgaaaagagaaaatgtgcgtgactgttctttataaactgtaagcgcttgaaaggttatgcttttcaaaggaagaggagcattgccttttacacccagtaactgtaggactatgagtaggtactgaccaggatattgggtgttatatagaagttaattcattcctgacttccgaacatttcagacaaatcttcggtgataaattgaaaatatttttcaaacaaccacataagattactatttcaaatattgaaaagtataaccaaagtagtctggaccatatccttcattggaaatattttaaaacagggtaaaatatcttctttggggcctcatttcatcagttctgcctacagaagcttgcctatcctatgattca

SEQ ID NO: 383284 - DNA, 144 bp, Homo sapiens
ggcggcgctatgctgtcctgcttcaggctcctctccaggcacatcagcccttcgctggcgtctctgcgcccggtgcgctgctgcttcgcgctcccgctgcgttgggccccggggcgccccttggaccccaggcagatcgccccc

SEQ ID NO: 383285 - DNA, 865 bp, Homo sapiens
ggatcaaaacatagatatttaatctgattcaaatataattgggttcctggcattttttttcttggcccactgataagtgaaggtactcaacagccgtatgttcaatatctgttaactcagttccctaagtcaaacaatatttgccaggaagttggattggggaatgtcaagattgagacttagcacatgtggcatgtaaacaatggccttgtttggcttctgtagaaaattcttctttgtgatctaggtagtcagcattacattttagtcagtgttactaggaggaaggcagatacaggagaagctttatccacattagaaagaagagtctcttcattgtgatgtcggctacaaccaggtcgttttccatctcttagccatcagcaaacagctatcagccatgcactgcttataccaagcactgtgccattcacgcttctcaccctggtgataatcacagtcttgaggagaatgcagacatactcaaagatgaggaaactgaggccctgggatgctagattgcctgtggtcacaaagctagtcattgtagagaaatgattaaaattcatgctcaaaattattctgcactctcttccatctcttgccaatctcccctcaaaaaggatcctaaaaattgtgttggcccagctctaatctaaagtcctgtgtatcacaggattacacatgccagctttgaacacaaagtgcaaggaaatgaagtagccgttaaagcagtttcattttaacatgcccttattgacctggcaggctgctagggagtctggggaggaattagacactgcacagaagcacaagctccagttccaaaccagagaaaaggcacatgcgtggcgggggtgggggt

SEQ ID NO: 383286 - DNA, 297 bp, Homo sapiens
attgtaagcatgtgaattatagctcaataaagctgttaattttaattcaattcaattcagttaattaaattaaaaaattaattagagctgttaaataatatatatattatatttttattatattatatattttatagttatttttattggattaaggaaatttgccctaattctagttggctaagacattcatcattatgattatcaatatttttaggaatttttaccaaagtagtatacctatagaatataaagagtcagttctgttgagaaaagcattcctctgacccactcctc

SEQ ID NO: 383287 - DNA, 473 bp, Homo sapiens
caggctgagggtccacctggaagataccaaggcgatggggcttggtgccgtcctgagtttgcaggccgaggctcacgctgctctgccaacactcacatacagtatccgcatcaaaggctgagtgtggccaagtgaaggagaaagcccctgtgcgggcacctgcagaggcgtccaccctgcccaggggcctctggggacgcagcgacccactgaccagtgagcgcagatgagcgactgcacctctctgcttcagctcttcatggccagatgggaggacaatccccaccttgcaaggtggcgttaaggactgagaaagaacgagcaccaggcctggccccatgagcactgctgggtctggatccaggcgccgtccaccttccacccggcagcactaatgcttccctccccggctgcactggcccttatctgggggtcaggaactcacgtgctgaataaagagcaactcttttcca

SEQ ID NO: 383288 - DNA, 1315 bp, Homo sapiens
ggaattcgggcacgagtgaaagatttcaaaccccaaacagtgcaactgaaacttttgcattactatactactgagaatatctaacatgttgttactaatcaatgtcattctgaccttgtgggtttcctgtgctaatggacaagaagtgaaaccttgtgattttccagaaattcaacatggaggtctatattataagagtttgcgtagactatactttccagcagctgcaggacaatcttattcctattactgtgatcaaaattttgtgactccttcaggaagttactgggattacattcactgcacacaagatgggtggttgccaacagtcccatgcctcagaacatgctcaaaatcagatatagaaattgaaaatggattcatttctgaatcttcctctatttatattttaaataaagaaatacaatataaatgtaaaccaggatatgcaacagcagatggaaattcttcaggttcaattacatgtttgcaaaatggatggtcagcacaaccaatttgcattaaattttgtgatatgcctgtttttgagaattccagagccaagagtaatggcatgcggtttaagctccatgacacattggactacgaatgctacgatggatatgaaatcagttatggaaacaccacaggttccatagtgtgtggtgaagatgggtggtcccattttccaacatgttataattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacatccatgtataataactgaagaaaacatgaataaaaataacatacagttaaaaggaaaaagtgacataaaatattatgcaaaaacaggggataccattgaatttatgtgtaaattgggatataatgcgaatacatcagttctatcatttcaagcagtgtgtagggaaggcatagtggaataccccagatgcgaataaggcagcattgttaccctaaatgtatgtcaacttcacttctcactcttatggtctcaaagcttcgaaagatagcttctgatattgttgtaatttctactttatttcaaagaaaattaatataatagtttcaatttgcaacttaatatgttctcaaaaatatgttaaaacaaactaaattattgcttatgcttgtactaaaataataaaaactacccttatattggaaaaaaaaaa

SEQ ID NO: 383289 - DNA, 479 bp, Homo sapiens
tgtgtacatatatgtacatatatatgtagtcctcctatgagtgtgaattatcttgagacttaaaaaaaaaaaaaacaacgttgaaaatgcagatgtcttcctaagaaatcaaataagatacagttaagagtatataaaaagctttatttagaaagtttccaataagactattgatttttccccacatataaagtattttttttcagattcttcagaaaagtgtgggcctcctccacctattagcaatggtgataccacctcctttctactaaaagtgtatgtgccacagtcaagagtcgagtaccaatgccagtcctactatgaacttcagggttctaattatgtaacatgtagtaatggagagtggtcggaaccaccaagatgcatacgtatccacttctgtagatgatcatgtccaagtttgagctccaaactatgcaagtggcaagactgaagaagaaattagtatcctcaaatca

SEQ ID NO: 383290 - DNA, 1229 bp, Homo sapiens
ttacgtttgattttaaaagctgcttatgacttgtatttctgttactgctaccgacttcaggcaggaagaattcatttttgtggagactttgcttgaagttagaaagttgggtgttttagattgaattgcagaaattttttaaagcaatgcactatgaaatcacagagaagcatataggtttgtccttcagaactaaaattgtatgtacttgcagtgtggtaattactgtagaaatggtttgtggctttaaagttaaggaacttgcataaataattacaagatgtaacttgtgtttgctatgtctggatatgttttcagttttaactgtactgtagtttcctaaaatatgaagggtagttaacatgaaagcaaaggtatggtaacatttatattgcaagtggcagctaagtttttgcagtggttctttgggactttgcaaatcgagtcactgtgtctttcgagttcatgtgttctgagttttatctatacatgaggaaacaagggggtcagtgggcctgtagagcttgtcattttggctggcataatgagccatctgacgaagatggacaaactcctgcaagatgtgagatagactatgaaatactctgattagactggctgctatagactaagccaaatcattctgctgtgttaggattagttatttctgagacacgcacttacattcacacacatgcctgcatataaatggtctcaatataaatctggaaatcaaaacaagcctctctatcagtgagagcttcctaggaaaaaggatagttttaattttgtgaaggacagtttccatcataaccttcatttagcgtctaaaagtcctagacaaacttgacggcccttttccttcaaacctcaggctggaatctggtgtggggctggccggggggacacagcagctagcaggcacactgtcaagcagtcctgctgtaggggcgatctatgtacgaatgaatccatttactttggacactttactacctgaacggaaacaatcaggcaggaacttgttcaataactacatggttggcctttcagcagaatttttgaactcttataaataaaccatacttgggataatttagtctttctctggtgagaaggaaacaagaaaaaaaaatgtgagcagtcactcttgagttaggtgcttgacgaggactgggcaatttacaacgtgcagttttgcttaacctttacagcaactgtccagaagt

SEQ ID NO: 383291 - DNA, 269 bp, Homo sapiens
aatgattttctggctatccatagcggacatgtctagatacatactctgttcattttaaaagatgaggaggttctgacacaatcagagaactttttaaaagttatggatgcctgagccccagccccagagataatgattaaacaggcctagaggttgttagtttttgaatgaagtttttagtttttatctgcctgagtgagtctgatgtgctattgtgttttacacagatcaatatgatggtagaatgaaacagagaaaacggggaagct

SEQ ID NO: 383292 - DNA, 572 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383293 - DNA, 4291 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383294 - DNA, 3189 bp, Homo sapiens
gcctgtctgcacagtggtgccagagaccaggcccttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383295 - DNA, 3457 bp, Homo sapiens
attggaattcagcctccccaggcctggccagcctcgtttatttagttaaactggtttgcaggcctcttcaataaaggtggggctgtgctaggcattggggatgcagcaatgaacaagacagacaaaaattgtccctcaaagaagagccgaccttctggtgggggagatggacagtaggcaggatgaataagtgctcgagaccaccacgtttggctcgttgcagagaaagcaggaagaggatggtgagggtcccctggtggtagccagggaaggcctccctgagatggcggcaggcacagcagcagctagccagaccctgctgtctgcatcttacattctaaccctatgcccggcctgggaggtgggtgctactaggcgaggaacggttcaggtagaaggaacaagtgcaaaggtcctgaggcagtaatgttgcaaagcagctccgcacccccttgctagggctctccaaccccacaacccccgacctgacaggccacctgtgcgctccccctccctcccacaccgtgcagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383296 - DNA, 4182 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383297 - DNA, 2432 bp, Homo sapiens
  misc_feature (151)..(151): n is a, c, g, or t
ctctttgttttcggtcatcaacagactaggacccctgctctgtctctgttggagctggcatacaaaacgggtaagacattgcctgcctggtgtcaccttctccaggaggacaggcaggtgaacgaatagcgggggcttgtacgcgggggcnttgtacgcgtacaaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383298 - DNA, 4832 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctggttttgtgtcttcagctgatggatgtgctgactagtgagagtgcttgggccctcccccagcacctaggcaaaggcttcccctccccctccggccacaaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgccccccccccagcccctcccttcattcccattccccaacctaaagcctggcccggctcccagctgaatctggtcggaatccacgggctgcagattttccaaaacaatcgttgtatctttattgacttttttttttttttttctgaatgcaatgactgttttttactcttaaggaaaataaacatcttttagaaacaaaaaaaaaca

SEQ ID NO: 383299 - DNA, 5020 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctggttttgtgtcttcagctgatggatgtgctgactagtgagagtgcttgggccctcccccagcacctaggcaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgccccccccccagcccctcccttcattcccattccccaacctaaagcctggcccggctcccagctgaatctggtcggaatccacgggctgcagattttccaaaacaatcgttgtatctttattgacttttttttttttttttctgaatgcaatgactgttttttactcttaaggaaaataaacatcttttagaaacaaaaaaaaaca

SEQ ID NO: 383300 - DNA, 4811 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctggaaaaaaaaaaaaaaaaaaaaaaaaaaaaaaaaaaaaaaaaaaaaaaaaaaaaaaaaaaaaaaaaaaaaaaacaaaaagaaaaaaaacaaaaaaagaagaggggggggcggccgcgtcaaaaactatcccccggcgagagggcacacagcgtgaagcactaccccccgcatttttcggaacaggagggccgccccctaagggggagggctctcaaaacaagcacgagcgcggcgccgccgatacaacaacacacttcgcggggacaaaacacgtgcacgacggggcgtctgtggggaggagaaacccccacacgaggggggggggaaacaaatatttgggggacccaaacctcctgcctacggagagataatatcgccccaccggggcgacgaacaaacaacccatcgtgagcggctgttagatgtgtggtgacaacacacggctgtattattgtgtgtgcggagaaaagaaagtttgctctccactggtttgtctccgagacagaaaattttatcaggcg

SEQ ID NO: 383301 - DNA, 2682 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383302 - DNA, 1455 bp, Homo sapiens
gtggtggagatggagagccctgagcctccactctcctggcccccaggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagttgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtgggcagggctcccgcgggggcgtggccagcttgagacccatccctgacacatcctcgtgtgcgcaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383303 - DNA, 1105 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccaccctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383304 - DNA, 2607 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggtgggcagaatcctgaccccccccttcccagccccatgctctctggggtccctccgattctgccctcaccaccctgcccaaccccaccaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatgggtaggactgagcgtggggcgggctcc

SEQ ID NO: 383305 - DNA, 194 bp, Homo sapiens
gagcacctgccccgggtgctgcaggagtctgagtgagtgcacggcaggttcctcctgcctggtcccgggctcagccttcctcatcccctgggcactgtgcctcactcagcctttgttctgtgcaggaggagtcaccaccttttttcctcagggaactcgagccagggaagtggggggcactcagccagggcttg

SEQ ID NO: 383306 - DNA, 4202 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383307 - DNA, 478 bp, Homo sapiens
ctgacctctggtgcacgatcggggcactgcaggggccgagccatgttggggggcccccctccttgctctgcaggcaccttagtggcttttttccgccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagcatggtcaacaatgtcacagccatctaccaataaccctgaatacttttaccgt

SEQ ID NO: 383308 - DNA, 4434 bp, Homo sapiens
gctccccagaaagttgcttagttctaggcagggatttcccttattcacagccgggagcagtgcctggcatagtgtgggcactcagcactcagcacatgctcactggatgagtgaatgaatgtgagcctgctgtttgctgtggactaaggatgtttctagatgtttgggcaaataccggatggtgggaagagctcaggctctgaagtctgcagtcttgggcccgaccctgggctcagccccagcctagctgtggggcaagattgtgagccttgtggtgcccaccttgtccaggtattgtgatgcactcgcagcagcaggcattgctttagacagcacaggtgctcgcaaaatggctgtatgtccgggaacaccagctcctgtgggtggctttctgtcctggtggcattgcccacacatacagctgtgtgccaacaagggttgtgcaaataaggttgtgtttggatgtgtgtgatgccctgtttgggggtcagtctctgcctcactcacgcaccctcttctccttttcacagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383309 - DNA, 4529 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggttgggccctgccacggtgcccccttccccactcccagccatatcctctgagcctcatgacagggccgggaagaccctaacagatcctacctcccatttcatagacagaataactgaggcctggagccacgtggggtcccacagtaaggtgggcagaatcctgaccccccccttcccagccccatgctctctggggtccctccgattctgccctcaccaccctgcccaaccccaccaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383310 - DNA, 4807 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggtgagggggcagctgctgaccagggatgtgctgtctgctcagcagggaagggcgcacatgggatgtgataccaagggaggctgtgtgtgtgtcagacgggacagacaggcctggcgcagtggctcacacctagcactttgggaggctcagttgggaggacagcttgagcccaggagttggaggccgcagtgagcctgagtgacagggagagtccctgtctcaaaaaaaaaaaaagaccaagcatcttcttgatggttacctgatgacaattcctttcacaaggaatcagtggggtgactgtcatttgtgggatacatgactgcacgtgcgtgactcagtctgtggactttgtgtgtgggctgagactagggtggggagaggggaacccgccaggcccccgccaggtacctgtgtgccaggtacaggcggctggtgccgtggcttgtgtgtgggcagggctcccgcgggggcgtggccagcttgagacccatccctgacacatcctcgtgtgcgcaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383311 - DNA, 2421 bp, Homo sapiens
  misc_feature (140)..(140): n is a, c, g, or t
taagtgttcagaaatttgatctgggcatccctagagctctcaacgctcccatacacctgctcaagcgccttcaggcattcggcagtggttatcgcggggttgttgtacttaaggatgcgaataacatcagcggcggggcnttgtacgcgtacaaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgg

SEQ ID NO: 383312 - DNA, 4339 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctggaaaaaaaaaaaaagaatttaattgggccgccttttacaacgtcgtgat

SEQ ID NO: 383313 - DNA, 4484 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccaggctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagacagagttcgctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacagtcagtcattcaatatgattcaaatgtctataaaccgaac

SEQ ID NO: 383314 - DNA, 4051 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggagttttgtgtcttcagctgatggatgtgctgactagtgagagtgcttgggccctcccccagcacctaggcaaaggcttcccctccccctccggccacaaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgccccccccccagcccctcccttcattcccattccccaacctaaagcctggcccggctcccagctgaatctggtcggaatccacgggctgcagattttccaaaacaatcgttgtatctttattgacttttttttttttttttctgaatgcaatgactgttttttactcttaaggaaaataaacatcttttagaaacaaaaaaaaaca

SEQ ID NO: 383315 - DNA, 2147 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgcttagcctcctgacctgaggctcctgtgctactttgccttttgcaaactttattttcatagattgagaagttttgtacagagaattaaaaatgaaattatttataatctgg

SEQ ID NO: 383316 - DNA, 1516 bp, Homo sapiens
gcctcgaccgcccagcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaaggtgaagtcggcgcggggaggggtagggccaacggctggacgccccaagggcgggcgcagatcgcggagccatggattgcactttcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcagtgagtcctggctttattgagctccagtctggcctct

SEQ ID NO: 383317 - DNA, 451 bp, Homo sapiens
ggggccgaggctgctccaaccctctgtaccctggagtgtatgccagtgtttcctatttctcaaaatggatatgtgataacatagaaatcacgcccactcctgctcagccagcccctgctctctctccagctctggggcccactctcagcgtcctaatggccatgctggctggctggtcagtgctgtgaggtcaggatacccactctaggattctcatggctgcacaccctgccccagcccagctgcctccagacccctaagcatctcctgtcctggcctctctgaagcagacaagggccacctatcccgggggtggatgctgagtccaggaggtgatgagcaagtgtacaaaagaaaaaagggaagggggagaggggctggtcagggagaacccagcttgggcagagtgcacctgagatttgataagatcattaaatatttacaaagcaag

SEQ ID NO: 383318 - DNA, 380 bp, Homo sapiens
ccattgtccatttgtttattcagtctcttacctccctgaacctcctcctctatcaaccccttctgtcttaattttcctcccatctatttgccagatcatgactagcataccaccatgcttcctgcagcatcttgaagtctcacttgaatttttttttttttgaatttttttttttgcctcgatctggcagccaattcttaaactggttgactcctggttttacccatccttgtcctcagggcagcctcagccattggtccaggccctcataagtctgcaggagagtgggtcccactgttgttcagttctacattcctccaggcagtcatgtccctggtaaaagaggtgagggctttttggagaagcaccattgaatatac

SEQ ID NO: 383319 - DNA, 294 bp, Homo sapiens
cctgattggagaaagcatggacagtcaagaagtagagaaagtgagtgcagatagctcttttgaagacttgaaatcaaaatcagaatgtacaatccttataatgaggtgcttcataataataaaaaatagtcacagtattttaaatgtatatattattttacagtttacaaaatgctttaatgaatctatttcatctgaaagtaaaaaatgtcatgaaagacaggtgtttaaatgttaggtgggtttgtggcatttcaaagacctcagttttctgaataaagacattctgagggg

SEQ ID NO: 383320 - DNA, 1095 bp, Homo sapiens
tgtttatcgatgccacccccgggcgcggtggcgcgtgcctcccaaagtgttgggattactgcgaccggctctaggatgcactcttgaagcatattattcccctgctgttttgtcatgcagccagacttgtccaatcatatgttttctttcagggctttggatcttgagagaataacgagctgtagggttttttggagacctttccagagtcatgtcagcgtgtggatcagactgttctttggcatggttctttgagctgctttctctggtctgttggcactgtttttttccagtctgattttccagtcatctttcagtgttgtgagtttcaacagccttccagtaaagttgctttttaaagatagccagagtcagttactaatgtttctaatgcttgtagacaagaactgtaatacagtaacttaactctatgtcttgaaaaataagtaggtacttgaggtaaataatatgtaatggggtaaaatacttaagattaaccaaaatgatagaactgacttttgtgtggcttttacacaggctccaaagatgttttccatttttggaataaggttcccaaggtcactactttgaagtataatagtgatgaagatgtataacttaacaaaaattgttttcctttctatacgtgtggtgatgtccaccatctctacatatcaaatctgtaaatcagaaattcagtcaacaagtattcagaatttccagatgtgctgagttttagtaatttaaaatataataaaggcttctgagtttttaatgaattttcgttgtttctaagacaaatgatatttccttcatattttttgaagttttgaatttttatctatttttttcaggtgtttaaacacaggtatgagatatacaggatctcagaaattacttttgaagttcattaaactatttgattgtactttttttcttttgagacagggcctagctttgtcttccagactggagtgtggtggtgtgatcatggctcactgcaacctcgacctcctgaactcaagcaatcctccctcctcagtctcctgaatagctgggactataggcgcaccctatcatgcccagctaattaaa

SEQ ID NO: 383321 - DNA, 4434 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383322 - DNA, 4391 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctttctgaacaggactgttcctctgacataacagactagaaacagccacctgtgcagggcctttgtcgacgc

SEQ ID NO: 383323 - DNA, 4334 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccaggatagacccaggagggacagaatacgaggtcgcaacgatgttctcatagactatcgattgagaaaataatacggtgaaggcccagac

SEQ ID NO: 383324 - DNA, 3711 bp, Homo sapiens
  misc_feature (3476)..(3476): n is a, c, g, or t
  misc_feature (3478)..(3478): n is a, c, g, or t
  misc_feature (3498)..(3498): n is a, c, g, or t
  misc_feature (3503)..(3504): n is a, c, g, or t
  misc_feature (3510)..(3510): n is a, c, g, or t
  misc_feature (3521)..(3523): n is a, c, g, or t
  misc_feature (3526)..(3528): n is a, c, g, or t
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgagcngngatcatgccattgcactccngcctnngtgacngagcaagactnnntannnaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatc

SEQ ID NO: 383325 - DNA, 4846 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383326 - DNA, 5158 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383327 - DNA, 5623 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctgactctggtggagcaacgttcaggtggttcaggaaagggcagcaataaggtgagatctggacagaggactcgaggcagggggagcttgccaaagagccttctgatgactatgtctttggctgtcccaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383328 - DNA, 4305 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccggaagttcaacattctgacttcaaaccagaaaactttgacccccgagaaggggcagagtcagggtttgatttgggactttggttacctgactctggtggagcaacgttcaggtggttcaggaaagggcagcaataaggtgagatctggacagaggactcgaggcagggggagcttgccaaagagccttctgatgactatgtctttggctgtcccaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383329 - DNA, 3343 bp, Homo sapiens
ctcaggtgatccacccgcctcagcctcccaaagtgctgggatcacaggcatgagccaccatagctggcctgcttttagtccaaaggaacaggggttgggggaagttcccagggcttgagaggtcttgaagccaaacaggggttccagggacactagggtgcccactctggcattttctctccttcccttcaattcacagactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383330 - DNA, 3111 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggatggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383331 - DNA, 2678 bp, Homo sapiens
gtggggcagggtgttgggcggtgtctcacagctgctctctgtgctccagacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383332 - DNA, 1126 bp, Homo sapiens
actgtggggtgctctagagatcccgggcaggtgctttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383333 - DNA, 2699 bp, Homo sapiens
  misc_feature (2699)..(2699): n is a, c, g, or t
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaaggtaactccctgaatcctgtggagctgctggatctagcccacattccaaatactggcacgttttctggaactagcagtacaatcaagcagacatcctctan

SEQ ID NO: 383334 - DNA, 2333 bp, Homo sapiens
  misc_feature (2098)..(2098): n is a, c, g, or t
  misc_feature (2100)..(2100): n is a, c, g, or t
  misc_feature (2120)..(2120): n is a, c, g, or t
  misc_feature (2125)..(2126): n is a, c, g, or t
  misc_feature (2132)..(2132): n is a, c, g, or t
  misc_feature (2143)..(2145): n is a, c, g, or t
  misc_feature (2148)..(2150): n is a, c, g, or t
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcagtgagcngngatcatgccattgcactccngcctnngtgacngagcaagactnnntannnaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatc

SEQ ID NO: 383335 - DNA, 1470 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggtgagaggtaccaccccaaccctcgtcctcgccatgcgctgtgatttgtaagttgcagtgccctgcatatagcaagagatactgttctctattgtctctgctcc

SEQ ID NO: 383336 - DNA, 766 bp, Homo sapiens
tgagttgtacaatgagactgcctgggatcacatacaagcttcatcccttactagttgtatgaccttaagcaagtcacttaacctttctgtgcctcagttttatcatctgtaatgtggggaaaataatagtacctgcctcagagggttgttttgaggattaaatgcattaatatgtggaaagggcttaatataagttgtacatagcatatgaaaactgttatgttaaatctattagcagttttatatgtgaaaatagctttgattttcatttcttggattatgaatcatgttgaataatcctttatatgcttcctggattctttttttttcttccccccagtcagtttctgactcttcacatatttacagagagatcttggaacctggatgggggaatccaggaaactcatggattccttcttcctgaattttatcacccaggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacaggtctagaggccaggcaggaaccctgggggaaagaaggaacaagggaagccattcttacagatactgagctatatattcttttcacacctctttctcctcagagcctttgtggtagaaacccagccctgcatgccccaaactccccatcgacccctcatcctcaaga

SEQ ID NO: 383337 - DNA, 362 bp, Homo sapiens
gaggatccattattgtcctgggctgacttcactaaggtaactccctgaatcctgtggagctgctggatctagcccacattccaaatactggccttcccacgtccctccttccctacaccagaggcaactcctcagcttttgctacctttccattcctcctccagcgagagagccctcctggcaagttaccattctggacatggctggacaaaattctggagttggtacatgaccacctgaaggatctctggaatgatgggtaaggccttggtcacccttccctcatgggcttgtgctttccgggcttgagagtggagtctctgcaccctcacgtggcaagcagggagagagagcaaagacag

SEQ ID NO: 383338 - DNA, 4026 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383339 - DNA, 3492 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagagaccctgtttaaaaaaaaaaa

SEQ ID NO: 383340 - DNA, 4937 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383341 - DNA, 5323 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383342 - DNA, 3568 bp, Homo sapiens
tccgcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383343 - DNA, 4783 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttgggggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383344 - DNA, 3808 bp, Homo sapiens
ctcaggtgatccacccgcctcagcctcccaaagtgctgggatcacaggcatgagccaccatagctggcctgcttttagtccaaaggaacaggggttgggggaagttcccagggcttgagaggtcttgaagccaaacaggggttccagggacactagggtgcccactctggcattttctctccttcccttcaattcacagactctggtggagcaacgttcaggtggttcaggaaagggcagcaataaggtgagatctggacagaggactcgaggcagggggagcttgccaaagagccttctgatgactatgtctttggctgtcccaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcttggtgtgataggttgcttctgagccagcctacactgctcccacccctgcagaaccagcagttcttctccaacccccccaaggccccctggagcttgctgggccctgctctcagttggcagttctcctcctatgttggccgaggcctcaactcagaccagctgagcatgctgagaaacaagctgttcggtacagatttccttttctctcagcctttccccagccttagtcttttctgtccctctgtcctatctatcccaggacccctggcttccctcatcatctgtctgtggctatctgtcccacagggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaacggggctcaagtgatcctcacgccttggcctcccaaagtgctgggattataggcatgacgccactgtgcttggcccaggatttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaac

SEQ ID NO: 383345 - DNA, 2275 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaagtgagtgaaaatggagggcaaggagagagaaagcagctttggaagaaggcataagaaggggataaacagaagcctcttggggtgggttagcactcctttcctctaacaaatacctgcagctagaaacatcacatccctctctgtgactcctgtcttctccccagacggacaccctccctgtggtgattatttccaacatgaaccagctctcaattgcctgggcttcagttctctggttcaatttgctcagcccaaaccttcaggtaggggagtggggccgacaggtcaaggcgcgagaggaggggtgtggaagcagtgtagctgctcagaacacctataggatccttaga

SEQ ID NO: 383346 - DNA, 2114 bp, Homo sapiens
acccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggaggttagtagatgtggtaggagttagggttgacagcgttcagcctaacacctccctgagaagcagcctcatcggggtcctctcccctctgcagaagctggtaaaatccatcagccaactgaaagaccagcaggatgtcttctgcttccgatataagatccaggccaaaggtaggaagcacattgaggggctggagaaagataagtgcctgctgagaagccggagctggaagtgaacaggagaaagctccgatgagcagtagtcactgtcagacacaccccactgactacagtcctgctgccgtgcaaagctggaagtgctttgtggaggctgagctggaggtgcagctgagagacagtaaatgttgaggaaatgcatggaaaactaacagtgttttatttgagggggtgtctggtccaagcatgaccattcagaatttgcctgagggtcccacaggtgcctgtgctttgcttggtttccctttcttcctccacaaaattcctccttcctgactctgactgagaccccagtcaggaaggagaggaaagaacccctggactgactcctgttcccaccatccagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaagggtaggtgcttgacaaggacactgcaaacatctgtacagtgtatgacctgcagaaccacattcggcagccctggtggcacaaacaaggaagagggggatttgggatatggacaaagggagatggcgagatctgaaatgaagtggaacttctgtttttttttttctgctgagtttttagaataattccattccttgtctccatgtatcttcctcctggaacagcttccggaagttcaacattctgacttcaaaccagaaaactttgacccccgagaaggggcagagtcagggtttgatttgggactttggttacctggtaagaatagtttgtgacctatgcttttattactatttttatttttttgagacggagtctcactctgtcccccaggctggagtgcagtggtgccatcttg

SEQ ID NO: 383347 - DNA, 444 bp, Homo sapiens
gcaagctttttgtcctgagaagactctttaatgtatatttggctatctgttgtattttatattctcagtgtaaaatatcaataaatgtttatatttataaaatctagttgttgttattgtgcaacttgacattcaacataaaagttacttaaaaccttatactgatagctaaaatctacaggtgtaggtgctcaagtagaatactagaatccggatacagatatatattgtgtaactttatgtatattatacatatatgctatatatgtgtatatttttatatacaataaatgtatagttatatattgatgccttgaactgagaaattgaaaatctaaaaatgaaagcatgagccatcatatctggcctgaaagttttattttcatgcttggggcatggtgtatagaaccagctactaagaatgtttattagcattagagattg

SEQ ID NO: 383348 - DNA, 641 bp, Homo sapiens
gcaagctttttgtcctgagaagactctttaatgtatatttggctatctgttgtattttatattctcagtgtaaaatatcaataaatgtttatatttataaaatctagttgttgttattgtgcaacttgacattcaacataaaagttacttaaaaccttatactgatagctaaaatctacaggtgtaggtgctcaagtagaatactagaatccggatacagatatatattgtgtaactttatgtatattatacatatatgctatatatgtgtatatttttatatacaataaatgtatagttatatattgatgccttgaactgagaaattgaaaatctaaaaatgaaagcaggccaggtgcggtggttcatgtctgtgatcccagcactttgggaggccaaggcaggtggatcacgaggtcaggagttgaagaccaacctggttaagatggtgaacctttgtttttgttaaaaatgtaaaaattacccgggcgtggtggcaggtgcctgtaatcacagctactagggaggctgaggcagagaattgcttgaacccaggaggtggaggttgcagtgagctgggattgtgtcacagcactccagcctgggcgacagagtgagactccgtctcaaaaaaaaaaaaa

SEQ ID NO: 383349 - DNA, 278 bp, Homo sapiens
gaggataatcaagatggtactgtttgtacctccgtggataaggaaaataaccaggctcatcctaaggagacaggaccatacttagaagagaacacctgtgatgctggctccttggccactgttcagcccaaaccatgaccagaggtaataaatgaccaaaacagaaaagacagacaaggagtggtaaagtaaaaggcaaagctagagatctaaaagaagggaggggaaatatttctgccctgagtactaaaaagtaaaagaggcaagattcagaaacc

SEQ ID NO: 383350 - DNA, 2136 bp, Homo sapiens
ttcagagcccagctaaattgacagcataactaacttttgtggacaaagtgtggattttgaagccagccaggcctaagtcaaatcctggttccaccacttactacgtatgggcaagttacttctctgaacctggttgttcattcatgtggaaaaggaagattagagataataaatgtaaagcatttggcttaggcagtaagtggcagctataatcagagggatgaggaaacatctttgcttgttggtgtttgataacataaagcgtgtttggtgaggtcttttctaatgttactcaggtgatagtgtgcaggaaatgacaagactgttaatgggaaactgattcatcaaccaaatgtattgataacccatcaacaaaatgtccaccactgtgctaaatgaattgggggaggaggcagaaaacagttctgctcttgaataaattaagcattatgacatgtgcactttgaattaagaaatgtttgctttcgctttaaactctagtaaaacttggaatgatttgcttgaaaagatgtgttgaaatggctttgaagaatagattagagcttgaagtgaagaaatttaggtttctgggaatagtatatgtcgtagttggggctcaggcatggtgacttgtgcctgcaatcccagctgaagtgtgaagattacttcaggccaggagtttgagaccagcctgaccccatctctaagaaaaaaatttttttaattagccacgcgtggtgacactcgcctatagtcctagctacttcagaggatgaggcaggaggatcacttcagcctagcatttcaaggctacagtgagctatgattgtgacactgcactccagtctgggtaacagcaagacccccatctctaataaaataagtacaatgctgactttttttgctttttgatgaatagggaaaaaatatttttttaatgtcataattggtgttgaagacatggtccagtaagaagcaattatgaaaaataataaacaatctagcatggatcaagccttatgaagaatctagaaatttaacaacataaaccagaaacaacgactattagattttacactaaaaattcgaaatcaatgagtaggaattcaaaggctctggaaggaagaagtgagcaacccaaaaggaagatggagcgataagaggaaagagcctttcaggaccctaaatacctgggtggtttttttaaggaactgttcattcttacagttatgctgccaaaccatgatatgcatgaaatgtcattgaaagtcaaggttgaaatgaagtcattttagagtttcaaagacaggtatgacagtcaccaaacagcacacaatatgacctcctggcatcattgaggaatcattacagaggaaaacgacttctgggaagaagaccaatggtaaagatgtatttcaagcaaaaattgcctgtatggcaaaaacgctggagagtctgaaaggaaggagtgagtacaaaagaaaaagcataacttagctacgtatgtaagcttatagtcccctagcagaagggcagtggatctccctactgggaagcatgtttgaacatatctagattgtgattagtaattgaaactcagagtgctgggattacaggcgtgagccaccacgcccggccggaaattttttttgagatggagtctctgtctgttgcccaggctggaatgcagtggcacaatcgtggctcacctcccaggtacaagcgattctgctgcctcagcctcccaagtagctgggattacaggtgtgcaccaccacccccggctaatttttgtattttttgtagaaacggggtttcaccacgttggccagcctggttttgaactcctgacctcaaagtgatctacctcacaaagtgctgggattacaggcgtgagccaccacacctggcctattataatttttttatatggagaaggaccaaaataatccaaagatgtaactctttgcattttgggttttttagttttactttttttcacatacaggtatgggcatgtgcacgcacgcactctgtctctcttcttttctttttttttttttaattaaaaaacccaccggccagttgtggtggctcacgcctataatcccaacactttgggaggccaaggctggc

SEQ ID NO: 383351 - DNA, 1727 bp, Homo sapiens
ttcagagcccagctaaattgacagcataactaacttttgtggacaaagtgtggattttgaagccagccaggcctaagtcaaatcctggttccaccacttactacgtatgggcaagttacttctctgaacctggttgttcattcatgtggaaaaggaagattagagataataaatgtaaagcatttggcttaggcagtaagtggcagctataatcagagggatgaggaaacatctttgcttgttggtgtttgataacataaagcgtgtttggtgaggtcttttctaatgttactcaggtgatagtgtgcaggaaatgacaagactgttaatgggaaactgattcatcaaccaaatgtattgataacccatcaacaaaatgtccaccactgtgctaaatgaattgggggaggaggcagaaaacagttctgctcttgaataaattaagcattatgacatgtgcactttgaattaagaaatgtttgctttcgctttaaactctagtaaaacttggaatgatttgcttgaaaagatgtgttgaaatggctttgaagaatagattagagcttgaagtgaagaaatttaggtttctgggaatagtatatgtcgtagttggggctcaggcatggtgacttgtgcctgcaatcccagctgaagtgtgaagattacttcaggccaggagtttgagaccagcctgaccccatctctaagaaaaaaatttttttaattagccacgcgtggtgacactcgcctatagtcctagctacttcagaggatgaggcaggaggatcacttcagcctagcatttcaaggctacagtgagctatgattgtgacactgcactccagtctgggtaacagcaagacccccatctctaataaaataagtacaatgctgactttttttgctttttgatgaatagggaaaaaatatttttttaatgtcataattggtgttgaagacatggtccagtaagaagcaattatgaaaaataataaacaatctagcatggatcaagccttatgaagaatctagaaatttaacaacataaaccagaaacaacgactattagattttacactaaaaattcgaaatcaatgagtaggaattcaaaggctctggaaggaagaagtgagcaacccaaaaggaagatggagcgataagaggaaagagcctttcaggaccctaaatacctgggtggtttttttaaggaactgttcattcttacagttatgctgccaaaccatgatatgcatgaaatgtcattgaaagtcaaggttgaaatgaagtcattttagagtttcaaagacaggtatgacagtcaccaaacagcacacaatatgacctcctggcatcattgaggaatcattacagaggaaaacgacttctgggaagaagaccaatggtaaagatgtatttcaagcaaaaattgcctgtatggcaaaaacgctggagagtctgaaaggaaggagtgagtacaaaagaaaaagcataacttagctacgtatgtaagcttatagtcccctagcagaagggcagtggatctccctactgggaagcatgtttgaacatatctagattgtgattagtaattgaaactcagaggccgggcgcggtggcctgtaatcccagcactttgggaggccgaggcgggcagatgacgaggtcaggagatcgagaccatcctggttaagacggtgaaaccccgtctctactaaaaatgaaaataa

SEQ ID NO: 383352 - DNA, 1516 bp, Homo sapiens
gccttccccatttgtttctttctgaaaggatttagcttaaggaaaaaaaaagctcttggtaaggccacatatttcaacctttcaaaatgactgcctctgtgaaagagtggttgagaaagaagaaaagagagagagagagagagagagagagagagaaaggtctaaacatctgtgtgaacagctctccagatactgtgaagtcaaaggcccaacattacagagcgcacctctgcctgagattaaggatagagctctatccttaatctcaatgctgactttttttgctttttgatgaatagggaaaaaatatttttttaatgtcataattggtgttgaagacatggtccagtaagaagcaattatgaaaaataataaacaatctagcatggatcaagccttatgaagaatctagaaatttaacaacataaaccagaaacaacgactattagattttacactaaaaattcgaaatcaatgagtaggaattcaaaggctctggaaggaagaagtgagcaacccaaaaggaagatggagcgataagaggaaagagcctttcaggaccctaaatacctgggtggtttttttaaggaactgttcattcttacagttatgctgccaaaccatgatatgcatgaaatgtcattgaaagtcaaggttgaaatgaagtcattttagagtttcaaagacaggtatgacagtcaccaaacagcacacaatatgacctcctggcatcattgaggaatcattacagaggaaaacgacttctgggaagaagaccaatggtaaagatgtatttcaagcaaaaattgcctgtatggcaaaaacgctggagagtctgaaaggaaggagtgagtacaaaagaaaaagcataacttagctacgtatgtaagcttatagtcccctagcagaagggcagtggatctccctactgggaagcatgtttgaacatatctagattgtgattagtaattgaaactcagagtgctgggattacaggcgtgagccaccacgcccggccggaaattttttttgagatggagtctctgtctgttgcccaggctggaatgcagtggcacaatcgtggctcacctcccaggtacaagcgattctgctgcctcagcctcccaagtagctgggattacaggtgtgcaccaccacccccggctaatttttgtattttttgtagaaacggggtttcaccacgttggccagcctggttttgaactcctgacctcaaagtgatctacctcacaaagtgctgggattacaggcgtgagccaccacacctggcctattataatttttttatatggagaaggaccaaaataatccaaagatgtaactctttgcattttgggttttttagttttactttttttcacatacaggtatgggcatgtgcacgcacgcactctgtctctcttcttttctttttttttttttaattaaaaaacccaccggccagttgtggtggctcacgcctataatcccaacactttgggaggccaaggctggc

SEQ ID NO: 383353 - DNA, 409 bp, Homo sapiens
gaacatactcacagtttccttggtcacagtgttgtcagtggttctataaaggtcttatgaatctctacttagttgaccacaagtagtaagcaagaaacaatcctgtaaagagaatggaggtcagaataaagaagccttgagggtttaaatcgcttcttgaaaagaaatgcccgtgtgtcaaggagctaagggagaccagcccaggaggagctgaatcctgccaacaatcacttgagtgaacttgagagtgaatcctctccatgttaagccttgaggtgattgtagctccatcaaataccttcattgtagccttgtgagagatctgagtcagaggatggagttaagccaagcccagattccagaccctcagaaactgtgagataataaatttgttgttctaagctactaa

SEQ ID NO: 383354 - DNA, 720 bp, Homo sapiens
gaacatactcacagtttccttggtcacagtgttgtcagtggttctataaaggtcttatgaatctctacttagttgaccacaagtagtaagcaagaaacaatcctgtaaagagaatggaggtcagaataaagaagccttgagggtttaaatcgcttcttgaaaagaaatgcccgtgtgtcaaggagctaagggagaccagcccaggaggagctgaatcctgccaacaatcacttgagtgaacttgagagtgaatcctctccatgttaagccttgaggtgattgtagctccatcaaataccttcattgtagccttgtgagagatctgagtcagaggatggagttaagccaagcccagattccagaccctcagaaacttgaaagcggaatacctggttatccggaggtcactgtctccacacagagtggtgtccttgatgctagcttggggcaaagaagccagagacacgttctgatttccaacaagctggaacagctctgctggtgaggagtgaaaggaaacccagactacccaacttctcatctctatggtcttggagccagcttgtggttgcaataggaatagaagagacttccttactccaatcccaccctaccccctcatcctgcctcaaccagtcatgcagagagatgctgaatggctgcctgctctcaggggaatgatttgtggaggtttaattaaaataatttaatcaatcaaat

SEQ ID NO: 383355 - DNA, 2591 bp, Homo sapiens
ctcaggccccctccgcctccacccctgccctcctcaggccccctccgcctccacccctgccctcctcaggcccccggcacgaggcccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagccgcgtagcagatacgctgccagcaacacgggcgaccatgctgatgagcaggacggcgattccaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcg

SEQ ID NO: 383356 - DNA, 541 bp, Homo sapiens
cagggaccagtgtgagcaaagccgctaaatgcatgaggacaaggaggactaactgagggccaatccagcaggcagcggacaggggttcagggacaactgcagtgacaggcacttcaggagggccctcgctgctatgttcacattacctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383357 - DNA, 4470 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtcccctgtgggacggacagtttggaagtggagcctccctaggctcctgtcctctctgccctagtacacatccagacatcctgtgctgcagggagggtgcagctgccttcctgcctgggccagggacctgctctgtgcacctgcaccatctcctgggtctgacctggtgggagggggctgcacctcactgtgtccagacccctctgcctaccttgccatcctccaagcctgcaccatgaggtgtgcctcctgtgggcacctctggcttccaccaccaggcagggcctcccccactgtggccgcccccacaaagccagactgttaaaaacacatgacaaatgctgggtatcagttcctttccacctggcttcccctggtcttgtgactggcagcagctataaagccagcaaaggaagctccagagagccagtcctcgggtgcgatcattcagccaggaagcaggaagccttggcctagccaggccccagcgctccccttctgcctcacccactcagtgtttgtgttggtcaagtggtgggggctaggagttggcttagagcagctgccagtgtgcaccggatgttgggagagcccatgcaatgactcagtggaaggactgactgcaacaccctgcacaggcagggcaggaggaggctgacgaagccccctcacctcccttgggatccctcctccagcctagccccctccctcaccaggccaggccccttgagaaacagagacagcaagcgaaggctcctgggcccaggggctcactcaagcacagatacccgaattccctctgccctgcaggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagcaaagcctttaagttcccgtccattctgtgattcccacgctgcttccagctcac

SEQ ID NO: 383358 - DNA, 3724 bp, Homo sapiens
ggcccgatgctccgaccccacactcccgtcgtccttccgctggtgcctgtcggtccaccctcggccctccgctgctgcacccgtccccctcccagataaaccaggagcgcccggcgtcccagacaagtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383359 - DNA, 2913 bp, Homo sapiens
tctagaggatcttaattctgcaccacagccccccagaggcatcgaacggaggctgaaagcatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383360 - DNA, 3070 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatgtccccgtacatcgttagaagcttgaattcgagcagtagtagtagtaggcggccgc

SEQ ID NO: 383361 - DNA, 3833 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383362 - DNA, 2398 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagcaaagcctttaagttcccgtccattctgtgattcccacgctgcttccagctcac

SEQ ID NO: 383363 - DNA, 2660 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcg

SEQ ID NO: 383364 - DNA, 3077 bp, Homo sapiens
ggcccgatgctccgaccccacactcccgtcgtccttccgctggtgcctgtcggtccaccctcggccctccgctgctgcacccgtccccctcccagataaaccaggagcgcccggcgtcccagacaagtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383365 - DNA, 2255 bp, Homo sapiens
acagaggaggtggacagccacagagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383366 - DNA, 345 bp, Homo sapiens
ggccctcgctgctatgttcacattacctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgtaatgggaaaaaaaataaataagcatccgaatagg

SEQ ID NO: 383367 - DNA, 3891 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383368 - DNA, 3418 bp, Homo sapiens
ggcccgatgctccgaccccacactcccgtcgtccttccgctggtgcctgtcggtccaccctcggccctccgctgctgcacccgtccccctcccagataaaccaggagcgcccggcgtcccagacaagtaagccgcgtagcagatacgctgccagcaacacgggcgaccatgctgatgagcaggacggcgattccaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383369 - DNA, 3681 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383370 - DNA, 3689 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctccccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttcacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383371 - DNA, 2870 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcg

SEQ ID NO: 383372 - DNA, 2578 bp, Homo sapiens
  misc_feature (2364)..(2364): n is a, c, g, or t
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaaccagcagcgatgacatgaccctcaccagccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtttggaaaggccccttggattcctggctggggacaatgatgacctggaccctggccagaagagccctggccctccagcaaggcagcacctgctctgatgcacctgtgcacccctggccctcccagccacctgggagcccgaagcttagcctgtaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagcaaaaaaaaaaaaccaaatngaaaaaaaaaaaaaactcgaggggggcccgtaccaattcgcctatagtgagtcgatacaattactgccgccgttttacaacgcggacttggaaaccttgcgtacccactaaatggctgagacatccccttttgcagttggcgaatacgaaaaggccgaccgatggctttccacagtggcaacctaatggcaaggaaaaggaacgctaaacttgt

SEQ ID NO: 383373 - DNA, 3795 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggttttccagcttgcagctcatctggtgtactggggcaaggccatcatcatctacccgctgtgtgagaacaacgtctacatgctgtctcccaatgccagcgtatgtctgtactccccgctggccgagcagttctcccaccagttcccatctcatgacctgccgtccgttcttgccaagttctccttgccggtctccttgtcagaatttaggaatcccctggcccccgctgtgcaggagacccagctcatccagatggtggtgtggatgctgcagcgccggcttctcatccagctgcacacctatgtctgcctgatggcctcacccagcgaggaggagccccgtccgcgagaggacgacgtccccagcatggacaactccagcgcagagctacttcccagcggggactcgccactgaaccagaggatgacggagaacctgctggccagcctgtcggagcatgaacgcgcagccatcctcagtgtacccgcagcccagaaccctgaggacctccgcatgtttgccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttccatttgtgaagtgccctgtggccccctccccagcacctctgtctgccatgcgcttcttcctcccaggctaccctgagcctttcctggcccagtcctcaccacagtccacagaagccacaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383374 - DNA, 2384 bp, Homo sapiens
ttcccatccgcaccagcaagagggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggtaagccgcgtagcagatacgctgccagcaacacgggcgaccatgctgatgagcaggacggcgattccagacaaagtttcactctgtcgcccaaggctggagtgcagtggtgtgatctcggcttgctgcaacctcacctctagggttcaagcgattctcctgcctcagcctcccgagtagctgggattacaggcatccaccaccaagcgagccatgtcctccaaccgatgagcaattggttgcagggttttcagatgttattctggcaacaattttggcaaccaagtctgaaatgtgtggccaaaaatttgaactgaagattgataatgtgcgatttgttgggcacccaacactgctacagcatgctctggggcagatctccaaaacagatccttccccgaagagggaagcacctactatgattctttttaatgtggtgtttgcactgagggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggaaatgaaggtcctcagtccccattccatcacatcctgcccaagtgcaagctggccagggacctcaaggaagcttatgacagcctgtgcacgtcgggcgtagttcggcttcacatcaacagctggctggaggtgagcttctgcctgccccacaagatccactatgcggcctccagtctgatccccccagaggccatcgaacggagcctgaaagccatccgcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcgcttcttcctcccaggctaccctgagcctttcctggcccagtcctcaccacagtccacagaagccacaaacaggctcatagccaagctgtgacctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtccccctggctggagatgttcatgcagaagtacatgccgtaaatgatgtacacgtacagggtccccggcttcatgaacatgcctcggttgcggggggtctgccggccaccccttgagtgggcggcttcatcctctggccccaggtatgcctcggtctccacgatgcggcctcggagttctgtgccattaggaagtcgccggactaggaccctgtccccagaaatgcccgggccagggggactgccggctggtcgaagaactccaaccccagtcgggtaaggtggccctttgggcttgagaaatagatgctgcggtatgggccccggagtggtgggcggtcccaagcagcgctccctggggcaaaggtgcctgggcctgcatcggacgagctgttgtggctgctctgcaggtgcctgggctgcgtcggacgagctgtgtggctgccctgctctagctggtcgctgcttcttttgccccatccgtcggcaaaactgggccccgctgcgcgcgggcatccggcggctcgggccggggcttcgtgggactcggaccccggcgcggagcccagcagccgccgaccacggaagcacccctaggaccggggc

SEQ ID NO: 383375 - DNA, 508 bp, Homo sapiens
aagctgacgcaggagaatcgcttgaatctgggaggcgggaggttgcagtgagctgagatcgagccactgcaatctagcctgggtgactgagtgagactccgtctctcaaaaaaaggaaaaaaaaaagcagtgaccatttggctccagagctacgtgggactcactgtagcacgaaaaagaagccaccagcagaaccctggtcccaacatcaggacgcaggcttgggcacctctgggtttgaacagccgtctgccgtcctgaacccactccgcccacctggtggtcagcgggaccgtggtgggcatggggtccaggaggcctgcccacccttgttggggggctgtggtggctgcctccctggccttcaccaccagctctgttcaggcctgtgggcagctcagagctgattcccagcagtggctcttcagcagaggcctctgggggctggtgtcaggttgggctcacacccacccatcccttccaggctccttcactacttccgcggccg

SEQ ID NO: 383376 - DNA, 376 bp, Homo sapiens
attctgttcaagggacagccacccagcttgtgttagaagtcattaactatactcagactcagttttcctgataccgtatgctatttcatgtggtttgaaataatttcaaggaagtgatcttcctagcattttcaaggaaaaacaccaaagcgcttagtagtctctgattttaactttgggagttgaaggttgctttctgcctcactgtcggtctgtcttctcctgatccaaagtgggaaagaatttggttcacccaaagtgtgcccccaccttttgtgttgttcccagagcttgtgtttcagcaccacttagcataactccatacttaaaacacagtgtggagcctgatacgctagtgacctcttggcattgttga

SEQ ID NO: 383377 - DNA, 182 bp, Homo sapiens
tcaaatgggaaagtggggtggttgcgtcaaacaagagaccatcagttcaccatttcaccagttcaggctgggcacttggcacagtttgtctcttctgaccctccaacaagcccctgaagtggggactatgaagctttacagaagatgatgctcaaactctgagaccaaatgtcagtttcccc

SEQ ID NO: 383378 - DNA, 390 bp, Homo sapiens
ctcagatcttagtggctgaaccaagagatggcacctgggaccttagccagtaaaacccgtccccttttttttgagacagtgtcttactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383379 - DNA, 3648 bp, Homo sapiens
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttgaagatggttcttaatttcttttaacctaattcctaatcctcacaaagatctttccaacagcaagttcagtaagttcaggtaacagtacgtcaccattggcttctggctcattgagtgatggtgggatcgcggtttcatctctgtaaacttgcccttgactggggagataccatctccttaaaaatactcttcattttcctaaggagtgaactgctgctgcacgaattcttatttgtggagggagtagctgcctccttacttcaccttcatgcaccagtgcagcgtgaacaggggctttattgatggggcttgggaagctgtaataaagtccagcatgcagattgtgaaggtttcgtatagccaccaggagacaagggtcaaaggaacgagcctctgtgggctctgctgcttagagtactttgtcctttctcagttcttaagggcaactgggaaggaagagggatcagcacttcacaaactgtctcataccttctcctgcagattaatgtcactgaaggctgtccctgactccacaccttcagcagcaaacccagc

SEQ ID NO: 383380 - DNA, 2818 bp, Homo sapiens
  misc_feature (2674)..(2676): n is a, c, g, or t
  misc_feature (2679)..(2679): n is a, c, g, or t
  misc_feature (2689)..(2690): n is a, c, g, or t
  misc_feature (2699)..(2700): n is a, c, g, or t
  misc_feature (2716)..(2716): n is a, c, g, or t
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatactnnnggngtggggtgtnnatatccagnntggggtgacgaatgtngaccggggggtgggggggatcaaccggcccgcggggaagggggtcaaacaaaaaaggcggcgcgggggggcgaacacgcggaggggttttgccggcccaaaa

SEQ ID NO: 383381 - DNA, 3039 bp, Homo sapiens
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383382 - DNA, 2635 bp, Homo sapiens
  misc_feature (2)..(2): n is a, c, g, or t
  misc_feature (8)..(8): n is a, c, g, or t
  misc_feature (22)..(22): n is a, c, g, or t
  misc_feature (33)..(33): n is a, c, g, or t
anctttcnggattgccctgttnggctaccgggnccggtaattcccgggtcgcacccacgcgtccgcccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383383 - DNA, 2986 bp, Homo sapiens
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383384 - DNA, 1804 bp, Homo sapiens
gtcccactgtattgcccaaggtggtctcaaactcctgggctcaagcaatcctcctgccttggcctcccaaagcactaggattataggcatgcaccactgcacccaacctttttctattactgattggttatcagactcacttttgaaaatttaggatttctaaacttacggccccactagcttcacctcagttgtaatgtgtctgctctctgtaaacaggttatctcagaagctcttctcaattgtcatccgtcattacctttttttgataaaattcaagacctggaaaggacctggagggtcatagttgtcctttcatgttgctatgaagtgctggaagtgaaagggacctccaagacattctaatcttctcttcctccattttatagggagaaaaccaagccactggccccgttacacagcaagttagtagtaagactgagattcgaaccctggtcaaacagactttccattttgttccactgactcaatcttctcttttacacttgaatcagacttttagttttattgtagtttttgagtccatagctgtcttcctgtactgtcttgactctttgactaaactgatttcacatctttaaaattatgctttccttttaggctcatttttagctcagctgttgacagctatttttaaatgtaacatgacataatatatttcctaaataatttacaataatctagcttgagctgctctgaaggttagtcagttggtggtgtgcatagaggtagagccttcccccactctcaaggatgctgtgaggggtattcctaccatgtggtgagttgggaggttttcctgaggtccttttccatcctgagactctggttttccattttgtttctcacaggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383385 - DNA, 3093 bp, Homo sapiens
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccaggctgcctattcccaaacttgaagacaccattaggagatacctcagtgcacagaagcctctcttgaatgatggccagttcaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383386 - DNA, 3117 bp, Homo sapiens
ctcatatctagaattttgggtaggtactttgaatcattacgatctatctacttcttaggtgaggaaatagaggtttaaaatttagtccacagtctcgcaaggatggagcctggatcaaattttgggttatcagattccaatcacgtttcttagcttttcttttttttttccaactccagtttctgtcttgctccaaaaaaggggaaggagcggctgcggcgctcggtttcccgcctcctagggaagggaagggagacgagcaacgcggaggctggggcccccttccgggcggggcctactagtgggcggggcctgtcagtgagcggcccctgcccggaaggagccagtccggggcggagccgatggccttacaggggccggaagtggcctgcgggcggagaagtgcctcaggagtcctgacgcagtgtcttgggcgctaacggcggcggcggccttgtgtttagactccagaactccccacttgccgcgttctcgccgccgcaggctcccgggacgatggtgccccgcctgctgctgcgcgcctggccccggggccccgcggttggtccgggagcccccagtcggcccctcagcgccggctccgggcccggccagtacctgcagcgcagcatcgtgcccaccatgcactaccaggacagcctgcccagtgctgccatattctcggcaagaacttgtaagagacacctagttaggtagatagcctcaagctgccgatgaggaagcctctcttgtaatgatggcctagttccaaggaaaacagaacaattttgcaagagttttgaaaatgggattggaaaagaactgcatgagcagctggttgctctggacaaacagaataaacatacaagctacatttcgggaccctggtttgatatgtacctatctgctcgagactccgttgttctgaactttaatccatttatggctttcaatcctgacccaaaatctgagtataatgaccagctcacccgggcaaccaacatgactgtttctgccatccggtttctgaagacactccgggctggccttctggagccagaagtgttccacttgaaccctgcaaaaagtgacactatcaccttcaagagactcatacgctttgtgccttcctctctgtcctggtatggggcctacctggtcaatgcgtatcccctggatatgtcccagtattttcggcttttcaactcaactcgtttacccaaacccagtcgggatgaactcttcactgatgacaaggccagacacctcctggtcctaaggaaaggaaatttttatatctttgatgtcctggatcaagatgggaacattgtgagcccctcggaaatccaggcacatctgaagtacattctctcagacagcagccccgcccccgagtttcccctggcatacctgaccagtgagaaccgagacatctgggcagagctcaggcagaagctgatgagtagtggcaatgaggagagcctgaggaaagtggactcggcagtgttctgtctctgcctagatgacttccccattaaggaccttgtccacttgtcccacaatatgctgcatggggatggcacaaaccgctggtttgataaatcctttaacctcattatcgccaaggatggctctactgccatccactttgagcactcttggggtgatggtgtggcagtgctcagattttttaatgaagtatttaaagacagcactcagacccctgccgtcactccacagagccagccagctaccactgactctactgtcacggtgcagaaactcaacttcgagctgactgatgccttaaagactggcatcacagctgctaaggaaaagtttgatgccaccatgaaaaccctcactattgactgcgtccagtttcagagaggaggcaaagaattcctgaagaagcaaaagctgagccctgacgcagttgcccagctggcattccagatggccttcctgcggcagtacgggcagacagtggccacctacgagtcctgtagcactgccgcattcaagcacggccgcactgagaccatccgcccggcctccgtctatacaaagaggtgctctgaggcctttgtcagggagccctccaggcacagtgctggtgagcttcagcagatgatggttgagtgctccaagtaccatggccagctgaccaaagaagcagcaatgggccagggctttgaccgacacttgtttgctctgcggcatctggcagcagccaaagggatcatcttgcctgagctctacctggaccctgcatacgggcagataaaccacaatgtcctgtccacgagcacactgagcagcccagcagtgaaccttgggggctttgcccctgtggtctctgatggctttggtgttgggtatgctgttcatgacaactggataggctgcaatgtctcttcctacccaggccgcaatgcccgggagtttctccaatgtgtggagaaggccttagaagacatgtttgatgccttagaaggcaaatccatcaaaagttaacttctgggcagatgaaaagctaccatcacttcctcatcatgaaaactgggaggccgggcatggtggctcatgcctgtaatcccagcattttgagaggctgaggcgggtggatcacttgaggtcaggagtttgagaccaacctggccaacatggtgaaaccttgtctctactaaaaatacaaaaattagctgggtgtggtggcatgtgcctataatcccagctacttgggaggttgaagcagaattgcttgaacccaggaggtggaggttgcagtgagctgagatcacaccactgcactccggcctgggcgacagagcgagactgtctcaaaaaaacaaaaaagaaaaaaaaactggggcctgtgtagccagtgggtgctattctgtgaaactaatcataagctgcctaggcagccagctacaggcttgagctttaaattcatggttttaaagctaaacgtaatttccacttgggactagatcacaactgaagataacaagagatttaagttttaagggcatttaatcaggaggaaaggtttggaaaactaactcaggtgtatttattgtttaagcagaaataaagtttaatttttgcttg

SEQ ID NO: 383387 - DNA, 481 bp, Homo sapiens
ctgcaaccctcacatcgtcctttgaccttgcctacatgacctcgggtcaccctgcaaccgccacatcgtcctttgaccttgcctacatgacctcgggtcaccctgcaacccccacatcgtcctttgaccttccctacgtgacctcgggtcaccctgcaacccccacatcgtcctttgaccttccctacgtgacctcgggtcaccctgcaaccgccacatcgtcctttgaccttgcctacgtgacctcgggtcaccctgcaacccccacatcgtcctttgaccttccctacgtgacctcgggtcaccctgcaaccgccacatcgtcctttgaccttccctacgtgacctcgggtcaccctgcaaccgccacatcgtcctttgaccttgcctacgtgacctcgggtcaccctgcaaccgccacatcgtcctttgaccttccctacgtgacctcgggtcaccctgcaacccccacatcgtcctt

SEQ ID NO: 383388 - DNA, 2135 bp, Homo sapiens
ggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383389 - DNA, 2206 bp, Homo sapiens
ggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggtgagcatggcaggatgggggtaagccgagggcccagctgagccattttaatcttcctgttccctcgctaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383390 - DNA, 2017 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383391 - DNA, 2058 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctgaaaaaaaaaaaacaagggcggccgctctagagtatccctcaa

SEQ ID NO: 383392 - DNA, 2049 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctgattcttttgtatctctagctgagtttaaaaaaa

SEQ ID NO: 383393 - DNA, 2801 bp, Homo sapiens
ggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgtaggattctttcctcagggatccagtctaggggatctggtgggatggagggtcgtcgatgtatggagtattgctttggagtcctcggccactcgctgggagaggaggaggatcgcagagggatccagcggaaatagcctcccaggaccgggatccccgtggatcccgggggatctcggggcataatctgcagggacaaaggcctcgggaggctcgggccgcgggagaactggggccgctgcattctgggttctggcggcaggtgccaggcagggcgcgagtgatccgctgatcgaggcggtggcagcgggaggacacccgctccgggcgaccggccgggggcgccctttcgcgccccagggctgcggccgctgggctacggggagccgcgggcggaccatgaagggcggagccccagggaaggggccggccctcaccccccgctcccccgctccccccttaccccaggccgcagcctgggattccccagggacccccccggagccgccgcgtctcccatggacttgcccggggactccaggtgagagcgtacccgggcggcccgcctgtcttgaccccgggagatggggatcctggcgaccgtgccgggaaactacagagccagcgacaggttcgggcgaccgtcctctgcttctttcaccctccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggtgagcatggcaggatgggggtaagccgagggcccagctgagccattttaatcttcctgttccctcgctaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383394 - DNA, 2088 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggtgagcatggcaggatgggggtaagccgagggcccagctgagccattttaatcttcctgttccctcgctaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383395 - DNA, 1400 bp, Homo sapiens
cggactactatgaggatccctcggcttggtatataaagatgggatgttgatgtcagaggcttgaagttcaattcttaaatgcagaacttagtgttttaagggtgggctaattcccctgtgcacaaagttgagcatgtggggaggggctgagacactgcagccaaggaatatccacctgtgaccctctcctttcctcagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383396 - DNA, 775 bp, Homo sapiens
cctgagtatccagtgggcaggagacgggggataatgcagtgaatcctgtttgtccctgagccttgaccttcttggcaggttgggttcaaccaaagggaaggagccaagagcctcaaaggaccaggtgctttcagaacctgagaccaaggtaggcattcagatcgggtagaagagactagtgggggcctgagcccatgtcactctttcaccctctgccccatttttgcagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383397 - DNA, 1699 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagccagaaaacacaacaagacaaaaacgccaatgaccgcagacaccacgcacccaccgacacatccaagaaaaaccacacagaccgccagcagcgcaaagaaagagacacagaaacgaaccaacagcgacacaaaccacagacacaccgccacaaaccaccaacccacaacacaacaaagaaagaaagcaacaaaagaaaacaacagacgccgcaaacacaaaaccagcaccagaaaccacgacacacacccaaacaaaaacaacgaacacaacacaaaggcaaacgaacgacgcacacacaacagaacaaagaacagaaggaacagacacagcgaaacaacaaaagcacaaggaaggacaagagacaaccagcgagcaaaacaaaaacaaaaccacagacagaacacaccgcaacggaacatacacacagcaaaccacaacagacaacggacaacagaacaacgcaccacagacaacagccaaccaaaccaaaacaacacaaaaaaccaaaaacaagaaaacacccaaagaacccgaaaacaagaagagagaagaagacgaagagacaacacagaacgaaacgacgacaccagaacagacaacaggacaaaaaaatcagaccaccaggcgcaacacaaagaacaaagagccaaaacaaaacgaaagaaaacgaacacagcacaccaaaaagacaacaaagagaaaagcgagaacccaccacacacgc

SEQ ID NO: 383398 - DNA, 1091 bp, Homo sapiens
aggctggtaccggtctgggatgttaaggcatgggagttgctggctcaggtgggatacctggaagttcccctagcctttaccttgcccttcaccccagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagccagaaaacacaacaagacaaaaacgccaatgaccgcagacaccacgcacccaccgacacatccaagaaaaaccacacagaccgccagcagcgcaaagaaagagacacagaaacgaaccaacagcgacacaaaccacagacacaccgccacaaaccaccaacccacaacacaacaaagaaagaaagcaacaaaagaaaacaacagacgccgcaaacacaaaaccagcaccagaaaccacgacacacacccaaacaaaaacaacgaacacaacacaaaggcaaacgaacgacgcacacacaacagaacaaagaacagaaggaacagacacagcgaaacaacaaaagcacaaggaaggacaagagacaaccagcgagcaaaacaaaaacaaaaccacagacagaacacaccgcaacggaacatacacacagcaaaccacaacagacaacggacaacagaacaacgcaccacagacaacagccaaccaaaccaaaacaacacaaaaaaccaaaaacaagaaaacacccaaagaacccgaaaacaagaagagagaagaagacgaagagacaacacagaacgaaacgacgacaccagaacagacaacaggacaaaaaaatcagaccaccaggcgcaacacaaagaacaaagagccaaaacaaaacgaaagaaaacgaacacagcacaccaaaaagacaacaaagagaaaagcgagaacccaccacacacgc

SEQ ID NO: 383399 - DNA, 2603 bp, Homo sapiens
ggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctcgcccggcgtctgattggcggaaccgcgctgtaggattctttcctcagggatccagtctaggggatctggtgggatggagggtcgtcgatgtatggagtattgctttggagtcctcggccactcgctgggagaggaggaggatcgcagagggatccagcggaaatagcctcccaggaccgggatccccgtggatcccgggggatctcggggcataatctgcagggacaaaggcctcgggaggctcgggccgcgggagaactggggccgctgcattctgggttctggcggcaggtgccaggcagggcgcgagtgatccgctgatcgaggcggtggcagcgggaggacacccgctccgggcgaccggccgggggcgccctttcgcgccccagggctgcggccgctgggctacggggagccgcgggcggaccatgaagggcggagccccagggaaggggccggccctcaccccccgctcccccgctccccccttaccccaggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383400 - DNA, 1800 bp, Homo sapiens
gctccgagaagaaggccatcggcggttgggcagcgttgggtaagcttggtttttaaaggagccggaggtgggagctgcggaagacccgggatccacgggaggcggcggccgcagcctgggattccccagggacccccccggagccgccgcgtctcccatggacttgcccggggactccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtccccgtggtgccctcaaagcagacctccataccacagcaccacagctaccatcaggatcctgtccacaggcagccgcctgcctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383401 - DNA, 1432 bp, Homo sapiens
agagcaaggctctgtctcaaaaaaaaaaaaaaaagaagaagccttaagggataggggagttgctggctcaggtgggatacctggaagttcccctagcctttaccttgcccttcaccccagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383402 - DNA, 1780 bp, Homo sapiens
ggagaccgctgggcggggacgcgaggagggaaggggcgtctgtgggcgggacctcccgggattggagtgaagagggtatctgcttgacagtggatccctggggatctacgctgagttcggagatgctccagctcgggccgcccctgtctgagcggagctttgcggcgctgaagcttacaggggaaggaaaagcctctcgccaccccggcaggccgggtggtcctcgcaggccaggcctcccgaccctctgtgtttgtgtcgcgagcccttgagccgcatccaccggacctcttccaccctgaggcggcgatcaaggacaacccctggcccagaggagggcccttcacaaaaggtggaccgggccccccagcccaccctggtggtgatgctggaagacatcgccagtcctagaccccccgctgagggcttcattgatgagacccccaacttcatcatcccagcacaaagagctgagcccatgaggatagttcgccagccaacgcctccacctggggacctagaacccccattccagccatctgctctgcctgcagaccctctggagagcccaccaacagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383403 - DNA, 682 bp, Homo sapiens
aaaaccaagcttacccaacgctgcccaaccgccgatggccttcttctcggagccagcagaacccaggttgggttcaaccaaagggaaggagccaagagcctcaaaggaccaggtgctttcagaacctgagaccaagaccatgggaaaggtttctcgattcagaatacgcagaacaccagcccgtcctcagctaaaccttacaccaatgggactgcctcgaccaatcaggttgaacaagaaggagttcagcttggaagaaatttacaccaacaagaattaccaatcacccacaaccaggaggacctttgagaccatctttgaggaaccccgggagcgcaatgggactctgattttcaccagctcaaggaagctccggcgggctgtggaatttcgggacagcagccttcctcgatcacgaagaccgtcccgtggggtccgggctgcagggggcaggactgttcctcccaatgtggcccccagccctgatgtgggccccctgctccagcagcggctggaggagctagatgccttgctcctggaggaagaaacagtagatcgggagcagccccactggacctaggtgccccatctgttggtcatccatcctgaagggacaggaaacctcccaggcagttatttttttttctctatatttctagtaaagttttcgatatgtttctga

SEQ ID NO: 383404 - DNA, 829 bp, Homo sapiens
cggactactatgaggatccctcggcttggtatataaagatgggatgttgatgtcagaggcttgaagttcaattcttaaatgcagaacttagtgttttaagggtgggctaattcccctgtgcacaaagttgagcatgtggggaggggctgagacactgcagccaaggaatatccacctgtgaccctctcctttcctcagccccagatcctgctctggagctcccatccaccccaccaccgtccagccttttacgcccccgcctcagtccctggggcttggccccgctcttccgttccgtccgctccaagctggagagctttgctgacatcttcctcacgcccaacaaaaacccacagcccccacccccgtcccccccaatgaagctggagttgaagatcgccatctcagaggccgagcagtctggggctgctgagggcactgcgtctgtcagcccccggcccccaatccgccagtggcgaactcaggaccacaataccccagcacttctccctaagccctctctgggccgaagctactcctgccctgatctggggccccctggcccaggtacctgcacctggccacctgctccaccccaaccaagccgaccacggccgcggcggcacactgtgggtggtggggaaatggcccgagccccgccaccccctcggccctgtctccggaaagaggtcttccctctcggaggagtgggagcctccccttctctcaccacatcttgctcgtccacggcatccacttccttctccgaaccagcagaacccaggtagtgctctcaaaaaacccccttgaagcctggctgcagcctggt

SEQ ID NO: 383405 - DNA, 379 bp, Homo sapiens
aacctcgctctgttcttgaagagctcatcttctagtgggaaggcagatgaggggatccagactcacaatccgtgaggggagacagagggctgcggtgtgatggcagtctaggaagattgagtggaggagcgccatgttggaagcatctcgaagacagaatgcaattccttctcgtgcatgaggggtgtcagaggaagtcccagtagaatgaacagcctgtgcaaaaggcgacactgagtatctcagtgctgggaacctggcaggtgctcagtggacatagctaagtgactgaagggtggaaggaagggagagcccagagaggtcaactgccttgctcaaggtcacacagcaggtttaggtcagagtcaggctcagcctc

SEQ ID NO: 383406 - DNA, 315 bp, Homo sapiens
aaacaacccaaatatctatcaacttatgcatgaataaccacaacgtgttatatccatacaatggaatattactcagccttaaaaatgaatgaagtactgatacacacttcaacatggatgaaccttgaaaacatcgtgctaagtgaaaaaagcccatcacaaagggacacatattgtatgattccgtttatgtgaaatgtccaaaacaggcagatttatagagacagaaaatacataagtattcaccaggggctgagtgtgggaagaatgagaacaactgtgaataggtacaggattctgggatcttcctaaaac

SEQ ID NO: 383407 - DNA, 1920 bp, Homo sapiens
caaagtatacaaatgttggcagggagcattcattttacaggtaaacatactggcatagaaggattttaggcaacctcatcagggtcacatagctaataaatgtcagaatgggattgaacctgggactgttagattctacgcctcctcattcattcatttattctctcactcattcacatgctctgttatgctgtatggtgttgagtaccatatttcagatattggcacattcggcttgtataaggggagacgcttttttgcagttggacggccattgaagacaagttggtcaccccaagttttctttccagttcttctgaaaaactcactaaagaaaaagaaagcaagaaatacagaaaagtatagaaaaataatccttattcccaccacctagaattaagttgttaacaagatgaaaacttcatactgaaaaaccaccctttctagaggcgatttaccacttattccttgcctttcaaaatatttacttttcaaggtaatctctccttattaatttgaaaaaaaaaatgtttcttttaaatagagattgttaacttggggtctggctaggctgtgaatcctctgatattaaacaaaagattttgttgaaggtgcttataaggctttatttttcttcctttctgctctagccccatatgtgcaggattttcattagatcctcaaagagttctgtgacccccaccctctccctcctaccttgttactttgaaacattctcactacagatttagtggggaatttggtcatttatttggattattaagagtttggaaactgcttctaactaagcagatgatgtggtaacaaagaaggcttatttgtgaaatagtgggtccaagattgatcacatctttctggtaaaccagccttatgcctactctcttttctcttatatcttcatgttttgccctttaattaatgaagcagtttacattgtgtgctgtggactgtcatatctgaaagcaaaagccttgtcttactcatctgtatatctcctgctatacagtaccatgtgtcttatgtaagtctttgtatctctgctaggttctcatgaagtcccatctctgtagtaagaataactcataaatatttctttattagccacctactgtgggaaatctttgggacttcaagtcttgaggtaacagaacttggttgcagctattatttacagtagatccctgtgggatgttttaattgaaccattatttttagtttagtcatttttaacctcaccaacttaactggagttagtattgtgaaagttttcagtgtttaataagcatcaaagtagcatattttgactctcggaaattcactagactatctgtttctgctgttacctgattatgccatctagttgattaggaaaacagtttttaggtccttgaggcagtgcagttgcatttatgacagtagtttatctgaatttttataaggataatttaatgggttaaaaaatgtggatttaatgaggaccttcataatttttccatacttgaccacagatgaaagggaatttttacttcacattggtatgcgaagtagtgcctgctggtaccacttatatttttgttaggaccagtaggaggcaccaacatccatggtgtaacctacaccaaacctaacttttttcagctttcatcttttcaaaaaaaaaaaaaagtaagtcattagggaattgaaggtggtgggtaaatacgaatacccttctagtcccttgaatcttacctatctggtacagttatgtccatccacttcttacccagaagcaaaataccctttctgacttaacagtgcttcacttcttaacatttttttgtctttagaaattattattattcattcctgaagggatgtagagttgtgggatgccttcagtagcttacaacaaaacca

SEQ ID NO: 383408 - DNA, 1896 bp, Homo sapiens
caaagtatacaaatgttggcagggagcattcattttacaggtaaacatactggcatagaaggattttaggcaacctcatcagggtcacatagctaataaatgtcagaatgggattgaacctgggactgttagattctacgcctcctcattcattcatttattctctcactcattcacatgctctgttatgctgtatggtgttgagtaccatatttcagatattggcacattcggcttgtataaggggagacgcttttttgcagttggacggccattgaagacaagttggtcaccccaagttttctttccagttcttctgaaaaactcactaaagaaaaagaaagcaagaaatacagaaaagtatagaaaaataatccttattcccaccacctagaattaagttgttaacaagatgaaaacttcatactgaaaaaccaccctttctagaggcgatttaccacttattccttgcctttcaaaatatttacttttcaaggtaatctctccttattaatttgaaaaaaaaaatgtttcttttaaatagagattgttaacttggggtctggctaggctgtgaatcctctgatattaaacaaaagattttgttgaaggtgcttataaggctttatttttcttcctttctgctctagccccatatgtgcaggattttcattagatcctcaaagagttctgtgacccccaccctctccctcctaccttgttactttgaaacattctcactacagatttagtggggaatttggtcatttatttggattattaagagtttggaaactgcttctaactaagcagatgatgtggtaacaaagaaggcttatttgtgaaatagtgggtccaagattgatcacatctttctggtaaaccagccttatgcctactctcttttctcttatatcttcatgttttgccctttaattaatgaagcagtttacattgtgtgctgtggactgtcatatctgaaagcaaaagccttgtcttactcatctgtatatctcctgctatacagtaccatgtgtcttatgtaagtctttgtatctctgctaggttctcatgaagtcccatctctgtagtaagaataactcataaatatttctttattagccacctactgtgggaaatctttgggacttcaagtcttgaggtaacagaacttggttgcagctattatttacagtagatccctgtgggatgttttaattgaaccattatttttagtttagtcatttttaacctcaccaacttaactggagttagtattgtgaaagttttcagtgtttaataagcatcaaagtagcatattttgactctcggaaattcactagactatctgtttctgctgttacctgattatgccatctagttgattaggaaaacagtttttaggtccttgaggcagtgcagttgcatttatgacagtagtttatctgaatttttataaggataatttaatgggttaaaaaatgtggatttaatgaggaccttcataatttttccatacttgaccacagatgaaagggaatttttacttcacattggtatgcgaagtagtgcctgctggtaccacttatatttttgttaggaccagtaacctacaccaaacctaacttttttcagctttcatcttttcaaaaaaaaaaaaaagtaagtcattagggaattgaaggtggtgggtaaatacgaatacccttctagtcccttgaatcttacctatctggtacagttatgtccatccacttcttacccagaagcaaaataccctttctgacttaacagtgcttcacttcttaacatttttttgtctttagaaattattattattcattcctgaagggatgtagagttgtgggatgccttcagtagcttacaacaaaacca

SEQ ID NO: 383409 - DNA, 631 bp, Homo sapiens
acagcccaaaatattggtagatggagaaacatctggttcccctttccacaaccaccttttcgttttagaaccagggtactttgtatgcagttgcttggattgttgatttccctcattctttgtagactcatctcaagtattctcagtaacttagattcccttgctcttcattcagaaatatttgttaaggtccattaaatgaaagtcaccacagttgatcatgtgaacagtgtcaagaatcaggccgaaccttcaaggagtttatgttctaaaacggaagcatggtggtacctgcttgtggaggctgaggcggaaggatcgcttgagcccaggactttgaggctgcataattgcattgacgctatccatagagtgcctgcaatttcaaatatcagaaaggatcgtacgagctatgatcatgccactgcactccagcctgaaccacagagcaagaccctttctctcaataaagtggaagtttgttcatttattcagtaaatatttattgattgccttctgtgtgccaagcactgttctaggtactgggattacagcagtgaacagataaatctcttccttcctggaacttacattttattgaagggaggagacatacaataaatgagtgaat

SEQ ID NO: 383410 - DNA, 204 bp, Homo sapiens
tcccagtcccaggggtgagtgatgtgtcccggcaagaaactgggctgttttacaaaataattttataggtgggagtttcctactcaaacacttctattttctcctatttcaggctgttcctcaagatgtgtcaggcttataaaaattaaatcttcagttgtaagaccagctaaaaggaaacataagtaccagtgagacagggga

SEQ ID NO: 383411 - DNA, 222 bp, Homo sapiens
ctgtccccagagaagtctcttcagcaatcacctctaccactctcgtgacctcttttatgtatgcttgatttcgtagttgggcccacaagatctagaaccatctctggagaacacttcctttatacttatgtattgggaacactgagggtgtctgtctcccactctggtgtcctgatacccattttactagtacctgagtgaaagcattacagtacgatggag

SEQ ID NO: 383412 - DNA, 513 bp, Homo sapiens
tgggcttgtcctgcccacacacactgtgaccgccggtattaaccgtagaaactagatgctttattcataggatttttctctgcacagtaaagctctcagagcaaaacacaggctgatctgagcttgagagaaagggattcctatcctaggatgtgaacatgggaaggagaccaggcccaggtacctgaagcttacacccgcctagtcttagatttcttgatggattctgggcttgccttcacctcaacaccacgccattcagcctgtcccgtctcctaaagtgtagaaggctggagattatatgatacagcctgcaagactctgagtggtgctgttcaaaccagcaagaaggacttctctggcatgagggaaagcaatacacctgtctctctcccagataaaaggaagaggcgagctcacagaacagacgtggcaggagctccacctgcagcagccaacctcccccttgtctgagtactggagccctcagttgtcccagataccaacgtgagc

SEQ ID NO: 383413 - DNA, 367 bp, Homo sapiens
ctactactactaaattcgcggccgcgtcgacaaacagataacctaaatatttgaggcactaggtcagaatgcatagggtgggccgagcacagtggcttatgcctggaatcccagaacttctggaggctgaggtgggcagattgcttgagcacaggagttcaagaccagcctggctaacacagtgaaaccccatctctacaaaaaatacaaaaattagccaggcatggtggcatgcgcctaaagtcccagctacttgggggctgaggtgggaagattgcttgaacctggaagctcaaggatacagtgagctgagatcatgccactgtactccagcctagaaggcaaagtgagactctgtctcaaaaaa

SEQ ID NO: 383414 - DNA, 279 bp, Homo sapiens
agacagtagaaatcatgactcacaggccagcaagtatacatgtttttagagatgaaacaagtgattgcaaacaggccgggtacatgagacagcctgctgcaggcacatgggggtcatctctggctggcaggaaggtgagggagtcctctcttctctggtcctggctgactctgcctcagcaggacttcacttgaccattctcaccttctgtcacctcatccttaaagtgacagagtaaattaactctaaggccccatccaggactcaagctgtgtgatt

SEQ ID NO: 383415 - DNA, 574 bp, Homo sapiens
  misc_feature (447)..(447): n is a, c, g, or t
  misc_feature (485)..(485): n is a, c, g, or t
cggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccaccaccaccaccatgcccaccaccaccaccaccatgcccaccacctccaccaccaccacgcactacagcagcagctaaaccagttccagcagcagcagcagcagcagcaacagcagcagcagcagcagcagcaacagcaacatcccatttccaacaacaacagcttgggcggcgcgggcggcggcgcgcctcagcccggccccgacatggagcagncgcaacatggaggcgccaaggacagtgctgcgggcggncaggccgaccccccgggcccgccgctgctgagcaagccgggcgacgaggacgacgcgccgcccaagatgggggagccggcgggcggccg

SEQ ID NO: 383416 - DNA, 2845 bp, Homo sapiens
  misc_feature (528)..(528): n is a, c, g, or t
  misc_feature (531)..(531): n is a, c, g, or t
  misc_feature (550)..(550): n is a, c, g, or t
  misc_feature (552)..(552): n is a, c, g, or t
  misc_feature (559)..(559): n is a, c, g, or t
  misc_feature (564)..(566): n is a, c, g, or t
  misc_feature (568)..(568): n is a, c, g, or t
gagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaaggacaagaagatggantanagaacttctttactgatgntnatgattnatatnnnancattttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaacaaatagtacattctgtctcatgtcacgtatcaattagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatagtggtagt

SEQ ID NO: 383417 - DNA, 331 bp, Homo sapiens
tccgggttgagatccacagagctaaacgttttagagtaccaaccattgtgtgctgtgaggtaaaggtgagccagtcctcatgatgcttaaatgtaattagaaaggaaaggaaccaaacctctcagaagcgataatgaaaatgttacagccagagaattgaacaagaactaagatacattgtagactggataaagagtttaaaggggaggtggttgaagatggaagtgatccagatcatctctgtggaaaaagtgtgtctttatcggggccttgatgggtaggattcgggtggtgagcaaaaaggagaacatcacaggaaggggaaaaatga

SEQ ID NO: 383418 - DNA, 633 bp, Homo sapiens
aatataatatgaaaacagatcttttataagtctcatgacaataacaaagtataaaagcaaactgttttttccccacaagaaaaccatctatagaatttacagaatgaaatgtcagcattctcgatgccatatgcaaatgttaatctgtggttgctcacactgtcatctaggacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatccttaccttcttagtaaaggtaactaactaaagtttgggctcacaaaccagaagaacatggaacatagatgccaggctctgagtctgtagacttcacagtcaggtgaaaatgtaagtttccatttatggggctacttttctttttttaggggggaaaaacattttgtttaatagctaattttaaaactaagtctcatacacaaaaagagtttatctggaccctatcaagggtgattttactttattttacagttattttctaactttgaaagcttatgttctctttatgataaaactaagctaattttaaaccc

SEQ ID NO: 383419 - DNA, 2844 bp, Homo sapiens
tcggcgttctggctacaggttcggggcgcgggtctcttccgcggaaactgacattgcgtttccgttgtcggcctcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaacaaatagtacattctgtctcatgtcacgtatcaattagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatagtggtagt

SEQ ID NO: 383420 - DNA, 2702 bp, Homo sapiens
tcggcgttctggctacaggttcggggcgcgggtctcttccgcggaaactgacattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaacaaatagtacattctgtctcatgtcacgtatcaattagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatagtggtagt

SEQ ID NO: 383421 - DNA, 2826 bp, Homo sapiens
agggtatgggctatcgtcgacccacgcgctccgattgcgtctccgtgcgtcggactcccactgcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaacaaatagtacattctgtctcatgtcacgtatcaattagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatagtggtagt

SEQ ID NO: 383422 - DNA, 2676 bp, Homo sapiens
agcggccgctcgcgatctagaactagattgcgtttccgttgtcggcctcccactgcaggagccatatattgaagaccatgtctgggagcttctactttgtaattgttggccaccatgataatccagtttttgaaatggagtttttgccagctgggaaggcagaatccaaagacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatgaggtttattatgcttcatgacataagacaagaagatggaataaagaacttctttactgatgtttatgatttatatataaagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaacaaatagtacattctgtctcatgtcacgtatcaattagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatagtggtagt

SEQ ID NO: 383423 - DNA, 359 bp, Homo sapiens
atttagatgtcaagccagaaatctaggatgtaactctatactgctttcttttatccatgtcatcttcattaccttaaaagaagtaattctaggtcaggcacagaatctcagcactttaggaggctgagatgggaggattgcttgagcccaggagttcaagaacagcttgggcaacatagtgagacctcgtctctacattaaatagaaaaattagctgggcatggtggcgtgcacctatattcccagctacttgggagactgaggttggggatggcttgagcctgggaggtggaggttgcagtgagccaagattgtgccattgaactccagcctgggcaacaacagagtaagaccctgtc

SEQ ID NO: 383424 - DNA, 836 bp, Homo sapiens
  misc_feature (18)..(18): n is a, c, g, or t
tacggctaggtacgaggnctgggtggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatactcatactgcaataccaaatccctgtgaattagcccaaaacagggacttggcatcagtcatgctgttacatttta

SEQ ID NO: 383425 - DNA, 1334 bp, Homo sapiens
gcaggagttcatgggccatctctttagggcatatctttattgggatgactgccaacccctttttgtctttggatgactcagctccaagtcccaaatatctgggagaagggatctgactggcctagcttgggttatttgctgagcccttgggaatcctgctaattgggaaagaagcagttccctaaacggaaagcagaaatgtttttaaatcttgtaacactatttgtggctaagatgtcattgcttttgttctgaatgactgtttcactttaattcctttctcggggtcagggagatttcccgtgagaacatctttagacagtaaaatatgtccttgggggttttaattcatgtttaagggattttgtcaaaagattggcctttcattggctgagaggattacagattgagaactcagttgtggatgatttccactgccattttccttgtcattcccctagggagggcttgtagttaggttgcgtctgctgcagctattgctcactgttcccctctcccggttgtagaaggaccaaagtggccaatgactctaagccctctgtccctcttgcagcacctgtgcctgtgtggaatactatgggaaggctctggaagtgctggtgaagggcgtgaagattatgtgcattcacggaaagatgaaatataaacgcaataagatcttcatggagttccgcaaattgcaaaggtgggtgggcttcattgaaggtagcagctctcctgccacactgctctttcaggtccccaaatgccccattctctagtagcctgtgctgtccgcatgtgttgtctttcctgcctggaaccctcttccctctctaatctggttatcacatctctgtaaacaccccgagcctccattgccctgttccaattgctttgccttttgctatgtcatttccctagttactgaacttctgtgctagacagcaggctccgtgacacaggagtcctgtgtattgtcttcactcccagattgccctgtgcccggtccagggaaaggttgtgatgactgtcaagcagcaaggagcaaatccatttgtcctgtctgggtagaaactgtctgtggcttaaggccggacacggtggctcacgcctgtaatcccagcactttgggaggccgaggcgggtggatcacgaggtcaggagatcaagaccatcctggctaacgtggtgaaaccctgtctctactaaaaacaaaaaattagtcgggcatggtggctggcgcctgtagtcccagctactccagaggctgaggcaggagaatggtgtgaacccaggaggcggagcttgcagtgagccgagactgcgccagt

SEQ ID NO: 383426 - DNA, 4502 bp, Homo sapiens
  misc_feature (291)..(291): n is a, c, g, or t
  misc_feature (416)..(416): n is a, c, g, or t
gaaacttgaaaaaaaaagacagttaatcctcattatttgtggattctgtatttgtgaatttgcctgctcgttaaaatttagaacaccccagtggatcctcggtgcttctgtggtcatgggcgtgggcagagctgcctttgttttcactgctcaggtgtaaacagtgtccttttcgtcatttatttagtgccatgttttttaccttttttttttttttcttttttccctgagacagggttttgctctgtcacccaggctggagtgcagtggtgtgatctcatctcactgcancctccacctcccaggcttaagctgtcctcctgcctcagccttccaagtagctgggactacaggtgtggaccatcatgtctgggtcattttttgtattttttgacatgttacccaggctggtcttnaactcctgggctcaagtgatccttccgcctcggcctcccaaagtgctgggattacaggtgtgagctaccgcgcccggccattttgcacatttttgtgctttatgttggtgattttgatttttgaaatggccccgtgatgtagtgcagtctagtgttcctgggtgcaagaaggttatgacgtgcagagaaaatccccgtgctagagaagcacaagctaaggcatgagttaatgtgctgttggccacgagttcaatgagaatgaatcaatagtatatgttaaatagagtcttttaagcacaaacagacataaaataggtttatgtattgattggttgacaaaaatgtcatgcccaaagactggcaggaacctaaccctgtgtttcccctgtgagcagtggttcagcattgactaattcactgttcttcatgacttgaaagagcataactgcagtatatgatgacgagtaaccgtaattcaaagtagttgatatgtgctcagagatgctgctgagaaagtctgggaactactgtttctctggaactttcctttgtgtggtagagggcggagggcctatgagttcctctctgggagtcccttgtgctgctgactgtgtcccttccttccatgtgggtaggttggagccataatcatcacccccactcgagagctggccattcaaatagacgaggtcctgtcgcatttcacgaagcacttccccgagttcaggtgaattggatgcagtgtccctgttagtcatgggctgttttgtcgaacttaatcaaaggctgttttcttgttgtagcccagattctttggatcggaggcaggaatcctggagaagatgttgagaggtttaagcaacaagggtgagtttgctcgtgtctgcttgtttctttgcttgcttttggcattgaacctaagaatcgatgtgtgatctcagcctaactgtgggtccccctttcagcagcctcctccccctgcaaaaaggtgttttctccaggccagcttcccattgtgctttgctggctccttcccataaggccctgatgagaacttcacaaactcaggttcttacagaggtcaagagaacgacgtgaagataaatgagtggtcaggggctgggggatggtgaggaactggccagcagctgccttgaatactcagctccagctggtagttgcctgggaggactcggctcagtagtggcaggttttgaattttttaaaaagaagatggaattccagatttgtgtgtgtaatctcctgattttttaactgttggcgtgtaatccacatttgaaaaacatatcttgtaggtgagccagtctgagggagccacatctggccctgagtctgccagtttgtgatctttacataggattctctaattctgtcaacatttccattttacaagtgagttacctgggacctacaatggttgagtaacttgcgtaagtcagaggttggtaagctttttttttataaaggagcagatggtaaatgttttcggctttgtgaaccatatggtctccatcgcacttactcaactgctgttgtagtgtgaaggcagcgatagacaacatgtgaataaatgggcgtggttttctgccaataaaatacttggcaaggacaggcagcagcccaggtttggtccgggagctggagtttgccaaccttgcctaggtcatagcccagaacccagatcccgtctcaccacagccctcagtctttctaccctgcagcactcttctactctcatgctcttcgttctcttcactagggcttaaatgactttggggggatataaaacttggtattttggtaatcatcaaccacattcccaagatccagagagtttggtaaatgttaactttctttccaaagtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383427 - DNA, 4469 bp, Homo sapiens
  misc_feature (291)..(291): n is a, c, g, or t
  misc_feature (416)..(416): n is a, c, g, or t
gaaacttgaaaaaaaaagacagttaatcctcattatttgtggattctgtatttgtgaatttgcctgctcgttaaaatttagaacaccccagtggatcctcggtgcttctgtggtcatgggcgtgggcagagctgcctttgttttcactgctcaggtgtaaacagtgtccttttcgtcatttatttagtgccatgttttttaccttttttttttttttcttttttccctgagacagggttttgctctgtcacccaggctggagtgcagtggtgtgatctcatctcactgcancctccacctcccaggcttaagctgtcctcctgcctcagccttccaagtagctgggactacaggtgtggaccatcatgtctgggtcattttttgtattttttgacatgttacccaggctggtcttnaactcctgggctcaagtgatccttccgcctcggcctcccaaagtgctgggattacaggtgtgagctaccgcgcccggccattttgcacatttttgtgctttatgttggtgattttgatttttgaaatggccccgtgatgtagtgcagtctagtgttcctgggtgcaagaaggttatgacgtgcagagaaaatccccgtgctagagaagcacaagctaaggcatgagttaatgtgctgttggccacgagttcaatgagaatgaatcaatagtatatgttaaatagagtcttttaagcacaaacagacataaaataggtttatgtattgattggttgacaaaaatgtcatgcccaaagactggcaggaacctaaccctgtgtttcccctgtgagcagtggttcagcattgactaattcactgttcttcatgacttgaaagagcataactgcagtatatgatgacgagtaaccgtaattcaaagtagttgatatgtgctcagagatgctgctgagaaagtctgggaactactgtttctctggaactttcctttgtgtggtagagggcggagggcctatgagttcctctctgggagtcccttgtgctgctgactgtgtcccttccttccatgtgggtaggttggagccataatcatcacccccactcgagagctggccattcaaatagacgaggtcctgtcgcatttcacgaagcacttccccgagttcaggtgaattggatgcagtgtccctgttagtcatgggctgttttgtcgaacttaatcaaaggctgttttcttgttgtagcccagattctttggatcggaggcaggaatcctggagaagatgttgagaggtttaagcaacaagggtgagtttgctcgtgtctgcttgtttctttgcttgcttttggcattgaacctaagaatcgatgtgtgatctcagcctaactgtgggtccccctttcagcagcctcctccccctgcaaaaaggtgttttctccaggccagcttcccattgtgctttgctggctccttcccataaggccctgatgagaacttcacaaactcaggttcttacagaggtcaagagaacgacgtgaagataaatgagtggtcaggggctgggggatggtgaggaactggccagcagctgccttgaatactcagctccagctggtagttgcctgggaggactcggctcagtagtggcaggttttgaattttttaaaaagaagatggaattccagatttgtgtgtgtaatctcctgattttttaactgttggcgtgtaatccacatttgaaaaacatatcttgtaggtgagccagtctgagggagccacatctggccctgagtctgccagtttgtgatctttacataggattctctaattctgtcaacatttccattttacaagtgagttacctgggacctacaatggttgagtaacttgcgtaagtcagaggttggtaagctttttttttataaaggagcagatggtaaatgttttcggctttgtgaaccatatggtctccatcgcacttactcaactgctgttgtagtgtgaaggcagcgatagacaacatgtgaataaatgggcgtggttttctgccaataaaatacttggcaaggacaggcagcagcccaggtttggtccgggagctggagtttgccaaccttgcctaggtcatagcccagaacccagatcccgtctcaccacagccctcagtctttctaccctgcagcactcttctactctcatgctcttcgttctcttcactagggcttaaatgactttggggggatataaaacttggtattttggtaatcatcaaccacattcccaagatccagagagtttggtaaatgttaactttctttccaaagtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatattatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383428 - DNA, 2640 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383429 - DNA, 2203 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggcctcccaaagtgctgggattacaggtgtgagctaccgcgcccggccattttgcacatttttgtgctttatgttggtgattttgatttttgaaatggccccgtgatgtagtgcagtctagtgttcctgggtgcaagaaggtcaaagtatgccggggaactctagag

SEQ ID NO: 383430 - DNA, 2706 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagggcttcgggtctcacctgtgaattgatggcatcctttaaccagtgctttgcaatctctctctttagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383431 - DNA, 2591 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383432 - DNA, 2712 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaagttgtgatggggagccctggggatatgatgccagccagggaaggtgagaatgtggtatgtgtgtgtgtgtagtgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383433 - DNA, 1613 bp, Homo sapiens
aaaaatttaacatactttacagagcatgtgaaatatttgggttggagttgggcttcagacctcaacagttgaaaaggaattgtttcgcttttgtttttcttggttgtgatggggagccctggggatatgatgccagccagggaaggtgagaatgtggtatgtgtgtgtgtgtagtgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383434 - DNA, 1176 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagattttccactggggactatgtcccacctgtatgatcagagagaaagatacaagttttacttaagagttcacattaaatgtttcttacaga

SEQ ID NO: 383435 - DNA, 1011 bp, Homo sapiens
  misc_feature (24)..(24): n is a, c, g, or t
  misc_feature (29)..(30): n is a, c, g, or t
gatctgcacccctctctcccaganaaggnnagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383436 - DNA, 191 bp, Homo sapiens
ttcaggactcccacctcccagctcagctcactgtccccacacgccgtccacatagacacagttgccacgtttgattcaacttctctatggtgacttggttactcagagccccttttgtggtgggacccactgtgaccttagctgcccattatgttcctagggcttcgggtctcacctgtgaattgatggca

SEQ ID NO: 383437 - DNA, 329 bp, Homo sapiens
agatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaagggtaagttggacttcttcatgtgataatgtctccatcttaactatgtggtggtcttacaagtatgagattgctttgtctcataaaaggaagtgttcccaggttttgagtagacacagaataaactggccactggctgctgagtattccttttaactttgtaaaaatgtaatttt

SEQ ID NO: 383438 - DNA, 3371 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcagaggtgaggacaacaaaagtgatttattttcacctagtcatcagagagttcacattggattaagaagctggctacaaatgtgagctaccgcgcccggccattttgcacatttttgtgctttatgttggtgattttgatttttgaaatggccccgtgatgtagtgcagtctagtgttcctgggtgcaagaaggttatgacgtgcagagaaaatccccgtgctagagaagcacaagctaaggcatgagttaatgtgctgttggccacgagttcaatgagaatgaatcaatagtatatgttaaatagagtcttttaagcacaaacagacataaaataggtttatgtattgattggttgacaaaaatgtcatgcccaaagactggcaggaacctaaccctgtgtttcccctgtgagcagtggttcagcattgactaattcactgttcttcatgacttgaaagagcataactgcagtatatgatgacgagtaaccgtaattcaaagtagttgatatgtgctcagagatgctgctgagaaagtctgggaactactgtttctctggaactttcctttgtgtggtagagggcggagggcctatgagttcctctctgggagtcccttgtgctgctgactgtgtcccttccttccatgtgggtaggttggagccataatcatcacccccactcgagagctggccattcaaatagacgaggtcctgtcgcatttcacgaagcacttccccgagttcaggtgaattggatgcagtgtccctgttagtcatgggctgttttgtcgaacttaatcaaaggctgttttcttgttgtagcccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383439 - DNA, 2410 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383440 - DNA, 2228 bp, Homo sapiens
  misc_feature (18)..(18): n is a, c, g, or t
tacggctaggtacgaggnctgggtggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagtgccttcgtgcatcgctgcggtcgcacagctcgcattggccacgggggcagcgctctggtgttcctcctgcccatggaagagtcatacatcaatttccttgcaattaaccaaaaatgccccctgcaggagatgaagccccagagaaacacagcggaccttctgccaaaactcaagtccatggccctggctgacagagctgtgtttgaaaagggcatgaaagcttttgtgtcatatgtccaagcttatgcaaagcatgaatgcaacctgattttcagattaaaggatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383441 - DNA, 2356 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaagtgggattttagtgtgcactgatgtgatggcccggggaattgatattcctgaagtcaactgggttttgcagtatgaccctcccagcaatgcaagatcttgattttgccagccttgctcgaggttttgccctgctgaggatgcccaagatgccagaattgagaggaaagcagtttccagattttgtgcccgtggacgttaataccgacacgattccatttaaagataaaatcagagaaaagcagaggcagaaactcctggagcaacaaagaagagagaaaacagaaaatgaagggagaagaaaattcataaaaaataaagcttggtcaaagcagaaggccaaaaaagaaaagaagaaaaaaatgaatgagaaaaggaaaagggaagagggttctgatattgaagatgaggacatggaagaacttcttaatgacacaagactcttgaaaaaacttaagaaaggcaaaataactgaagaagaatttgagaagggcttgttgacaactggcaaaagaacaatcaagacagtggatttagggatctcagatttggaagatgactgctgattccagtgccacagatgaacccacaaggacatagctgttccctaacttggtggatggctccagtttgcttttaacgaaaatcacaacttcaggagacatctgaaaagaatgatgtctctgaaagctgtcctttcagatgagggagaaatgaaggatttcacacttcagaatattttactaaaaacattccagtcttggccgggtgcggtggctcctgcctataatcccagcactttgggaggctgaggcaggaggatcacttgagcccaggagttcaagaccagcctgggaacacagcgagaccctctcattaaaaacaacaaaacaaaacaattccagtcttggagtagtctaacagaagaaaatgtaaaattatttgagtgtaaataatagatgtcagtatttatcatgatgggtcacatatagacatatgtacatatatatatatatatatatatatatatatatatatatatatatatatatataagctcttttttctgaggctattttatagttatttttaaacataaagatacagaagtcttcttgacttctgattttcaaaaccattcctcagtatcttcaggcatttgacctcctgaatgtgcttggccctgggcttcagttatcctttgatgtcctgcaggggtggctaatgtgctggggtttttctgtgttaatagtcacagtattgttttattggtgaatagctgaaaaacagagggattaagtcatattccgggaaagagaattatagtttttatgcctcctgttgaataaatggtgtcctgattgcc

SEQ ID NO: 383442 - DNA, 1621 bp, Homo sapiens
tcgagcagcggcgaccgacgcggcgaaggagcgcgccatggagcatgtgacagagggctcctgggagtcgctgcctgtgccgctgcacccgcaggtgctgggcgcgctgcgggagctgggcttcccgtacatgacgccggtgcagtccgcaaccatccctctgttcatgcgaaacaaagatgtcgctgcagaagcggtcacaggtagtggcaaaacactcgcttttgtcatccccatcctggaaattcttctgagaagagaagagaagttaaaaaagagtcaggttggagccataatcatcacccccactcgagagctggccattcaaatagacgaggtcctgtcgcatttcacgaagcacttccccgagttcagccagattctttggatcggaggcaggaatcctggagaagatgttgagaggtttaagcaacaaggtgggaacatcattgtggccactccaggccgcttggaggacatgttccggaggaaggccgaaggcttggatctggccagctgtgtgcgatccctggatgtcctggtgttggatgaggcagacagacttctggacatggggtttgaggcaagcatcaacaccattctggagtttttgccaaagcagaggagaacaggccttttctctgccactcagacgcaggaagtggagaacctggtgagagcgggcctccggaaccctgtccgggtctcagtgaaggagaagggcgtggcagccagcagtgcccagaagaccccctcccgcctggaaaactactacatggtatgcaaggcagatgagaaatttaatcagctggtccattttcttcgcaatcataagcaggagaaacacctggtcttcttcagcacctgtgcctgtgtggaatactatgggaaggctctggaagtgctggtgaagggcgtgaagattatgtgcattcacggaaagatgaaatataaacgcaataagatcttcatggagttccgcaaattgcaaaggtgggtgggcttcattgaaggtagcagctctcctgccacactgctctttcaggtccccaaatgccccattctctagtagcctgtgctgtccgcatgtgttgtctttcctgcctggaaccctcttccctctctaatctggttatcacatctctgtaaacaccccgagcctccattgccctgttccaattgctttgccttttgctatgtcatttccctagttactgaacttctgtgctagacagcaggctccgtgacacaggagtcctgtgtattgtcttcactcccagattgccctgtgcccggtccagggaaaggttgtgatgactgtcaagcagcaaggagcaaatccatttgtcctgtctgggtagaaactgtctgtggcttaaggccggacacggtggctcacgcctgtaatcccagcactttgggaggccgaggcgggtggatcacgaggtcaggagatcaagaccatcctggctaacgtggtgaaaccctgtctctactaaaaacaaaaaattagtcgggcatggtggctggcgcctgtagtcccagctactccagaggctgaggcaggagaatggtgtgaacccaggaggcggagcttgcagtgagccgagactgcgccagt

SEQ ID NO: 383443 - DNA, 412 bp, Homo sapiens
atagccatggggattattattgccaaatatgttttttattagtttccctttttattttgcaggtatgcaaggcagatgagaaatttaatcagctggtccattttcttcgcaatcataagcaggagaaacacctggtcttcttcaggtactcctctggtctctgtggtagaggcatcagggattcagccagaatgtgcaggtgcatgcggcctttgggttttggattccatctagcatggttctctccggaatgcttttggctgcaaataactgaaaacccaacttttgttgtccgaacaaggttggctttatttttctcccgtaaaaagtcgtccaaaggcaggcagtttctcacatgggtttcatgtgtcagtcatgtcaaggtcaatgttgatgtgattggtcttctctt

SEQ ID NO: 383444 - DNA, 2502 bp, Homo sapiens
tgatagagcagagacagtagttgtggggccacctaggagagtctgggtatagacaacatccccagccactccccttccctgaaggaggtctcagctgcagcaggagagaaggctgcctctgcctctctccttagacttcccttcttcccccctcatttcccttctagacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttcta

SEQ ID NO: 383445 - DNA, 2383 bp, Homo sapiens
ggcgggagggcccggcccgatttcccttgctgctccccttgtggcctgacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttcta

SEQ ID NO: 383446 - DNA, 2484 bp, Homo sapiens
gtctctctgtccctctgtctctctctctctgtttctctgtgtgtgtgtgtgtgtgtgtgtgtgtctctctctctttctgtctccctctccagccccaccctttcagtctcctccgggtgcactgataaggttggaaagtggaatggtggacgctgacagaggcaaaaatctgctaactcagggggcagactcaaccaagactgtgagcaggcctggggaatgaccccccgatctccaaccagtgccttccgcagctgcacggctgtctccagctgtctctgcccctcttcctggccctggctccatctctctgtcacctcacccttccctgtgccacatgggccctctctctcctgccaggacgctgcggctctggggacctcggagcctgggggtggctctgggagtcttcatgaccattggctttgcactccagctcttgggagggcccttccagaggaggctacctgggctacagctccgacagccctcggccccatccctacgaccagcccttccgtcctgcccaccccggcagcgactggtgttcctgaagacacataaatccgggagcagctctgtgctgagcctgcttcaccgctatggggaccagcacgggctgcgcttcgccctccctgcccgctaccagtttggctacccaaagctcttccaggcctctagggtaaaaggctaccgcccacagggtggaggcacccagctccccttccacatcctctgtcaccacatgaggttcaacctgaaagaggtacttcaggtcatgccttctgacagcttctttttttccattgtccgagacccagcggctctggctcgctctgccttctcctactataaatccacctcatcagccttccgcaagtcaccatctttggctgccttcctggccaatcctcgaggcttctacaggcctggggcccgtggggaccactacgctcgcaacttactatggtttgactttggcctgccctttcccccagagaagagggccaagagagggaatattcatccccccagagaccccaaccccccacagctgcaggtcttgccttctggtgctggccctcgagcccaaaccctcaatcccaatgccctcatccatcctgtttccactgttactgatcatcgcagccagatatcaagccctgcctctttcgatttggggtcttcatccttcatccagtggggtctggcatggctggactctgtctttgacctggtcatggtggctgagtacttcgatgagtcattggttctgctggcagatgccctgtgctggggtctagatgacgtggtgggcttcatgcacaatgcccaggctggacataagcagggcctcagcactgtcagcaacagtggactgactgcggaggaccggcagctgactgcacgggcccgagcctggaacaacctggactgggctctctatgtccacttcaaccgcagtctctgggcacggatagagaaatacggccagggccggctgcagacagctgtggccgagctccgggctcgccgagaggccctagcgaaacattgtctggtagggggtgaggcttctgaccccaaatacatcactgatcgccggttccgccccttccagtttgggtcagctaaggttttgggctatatacttcggagtggattgagcccccaagaccaagaggaatgtgagcgcctagctacccctgagctccagtacaaggacaagctggatgccaagcagttcccccctaccgtctcactgcccctcaagacttcaaggccactctccccataaacatcagactacagatttaggtggaagagcagccatgtttgaagggcacatgtgatgagtggggggcagcaagatgccatttctgcatctcccagaagggatgagtctttgtcccgatgcaagccccctcttcgctgggctcccagcagtgcttccctcctccaccctccactcattttgttctttccccccaactttttttttttttgaaacggagtcttgctctgtcccccaggctggagtgcagtggcatgatctcggctcactgcaacctctgcctcccaggttcaagcgattctcctgcctcagcctccagagtagctaggattacagatacgtgccaccatacccggctaatttttatatttttagagacagggattcaacatgttggttaggctggtcttgaactcctcacctcaggtgatccacatgactctgcctcccaaagtgctgccattacaggcgtgagccactaggcctgacctccccttcccctttcctgccccaaggcagatccacatcaccgaagctccctagaggggcaaaagatggagtgagccacaggaagtttggggcgtggtgagttggaatgatacgtccatttctctatgaaatatttgctactagactgttcatttctctctgacatgtttgttgaatgaataaataatttgaaacttcta

SEQ ID NO: 383447 - DNA, 524 bp, Homo sapiens
ggaaatggggcccacagaccaatgcttctcagccccctggattcagcccccttcctaggggtatgtacggacctcccgtcttgctgaagatcctgagccaaaggaattattggctgcagcatcatcaaatcactaatgtattaccaatgaagagccggcatcttgggcttttaccctgatgggaaccatcaagcagaaccttctggacctgtacttccgagttcactagggctgggagaactcagcccagggatcagcaacgcatgtacgagtctctccagaagagttttggagactgagaagtccaagatcaagtggtcagcatctgatgaagcctggacacactgttaacaacacatgtgatggaaatgcatcaggatggggtatatttttagctacagcaaatcatcattcctttatgcgttcagattttcatctctgcagattaattatctggttcttacatttttcagagtaaattgaaactgatttttcctaataaagaaggaagatagactctaaga

SEQ ID NO: 383448 - DNA, 825 bp, Homo sapiens
ggaaatggggcccacagaccaatgcttctcagccccctggattcagcccccttcctaggggtatgtacggacctcccgtcttgctgaagatcctgagccaaaggaattattggctgcagcatcatcaaatcactaatgtattaccaatgaagagccggcatcttgggcttccaggccttgcgtttgtgagtataggaagttcctgctgcaatgtcagaagtccaggctccttttcttggaagaaagaccatgtgaagaagcgtgttgtcagatgtgatgaagaagccattgcggatactcagccctgttgagacttcacatggctccagcctcagcagctatatgaccacaacagcacgagagaccccaaatgaggactgcccagatgagttcatttaccctgcaaaactaagagggataatactaatgaagcgttgcctcaagccactaagttttaccctgatgggaaccatcaagcagaaccttctggacctgtacttccgagttcactagggctgggagaactcagcccagggatcagcaacgcatgtacgagtctctccagaagagacataacactgactgtatgctctacaactaactaatcttcagtttgcagaagaggaaactaaaggacaggaagttggctgattcctacaatgagcagaagttacagcaaaggtcaatgccaggactgagttccctgtttttctcactcacattctttaagttggtacctgggcccctggtgcaggatgggttcttcataaacctttattaaataagtgttcaataaatcaatactcagttttctccattgtaaag

SEQ ID NO: 383449 - DNA, 808 bp, Homo sapiens
ggaaatggggcccacagaccaatgcttctcagccccctggattcagcccccttcctaggggtatgtacggacctcccgtcttgctgaagatcctgagccaaaggaattattggctgcagcatcatcaaatcactaatgtattaccaatgaagagccggcatcttgggcttccaggccttgcgtttgtgagtataggaagttcctgctgcaatgtcagaagtccaggctccttttcttggaagaaagaccatgtgaagaagcgtgttgtcagatgtgatgaagaagccattgcggatactcagccctgttgagacttcacatggctccagcctcagcagctatatgaccacaacagcacgagagaccccaaatgaggactgcccagatgagttcatttaccctgcaaaactaagagggataatactaatgaagcgttgcctcaagccactaagttttaccctgatgggaaccatcaagcagaaccttctggacctgtacttccgagttcactagggctgggagaactcagcccagggatcagcaacgcatgtacgagtctctccagaagagttttggagactgagaagtccaagatcaagtggtcagcatctgatgaagcctggacacactgttaacaacacatgtgatggaaatgcatcaggatggggtatatttttagctacagcaaatcatcattcctttatgcgttcagattttcatctctgcagattaattatctggttcttacatttttcagagtaaattgaaactgatttttcctaataaagaaggaagatagactctaaga

SEQ ID NO: 383450 - DNA, 539 bp, Homo sapiens
ggaaatggggcccacagaccaatgcttctcagccccctggattcagcccccttcctaggggtatgtacggacctcccgtcttgctgaagatcctgagccaaaggaattattggctgcagcatcatcaaatcactaatgtattaccaatgaagagccggcatcttgggcttccaggccttgcgtttgtgagtataggaagttcctgctgcaatgtcagaagtccaggctccttttcttggaagaaagaccatgtgaagaagcgtgttgtcagatgtgatgaagaagccattgcggatactcagccctgttgagacttcacatggctccagcctcagcagctatatgaccacaacagcacgagagaccccaaatgaggactgcccagatgagttcatttaccctgcaaaactaagagggataatactaatgaagcgttgcctcaagccactaagcagtgccacaatcaaggccttgggtgagactgtgcctggagttgccgaaagcctttgcccataaaagttgcttttctctgttaataa

SEQ ID NO: 383451 - DNA, 1169 bp, Homo sapiens
tgaattttgaccaaatgaagtaggagatagcagtaagctgtatttgtgtactttcccctctcctggctgtttgcctctgaataatgaattttcctagaaaatgctatctgcaggcggacagattgtacctgtttagaaaaatgtaatcctgctgaggatatggctccttcctggtttgcatattttgctgttttcttttttagcttgtagacacagtggcctctgtctagactgctggccctgcctttctcttatataattcatgccatgggcctggagcacccacgagagtcagagccattttttaaaattgttttatctgagatgttgtggttgaaaccattactcttaagttttttatttttgtcttggaggctaagcagctttatatgtttgcttttaaatttatttaaagtttcctgacatccatatttcttagctatctttcttactgtatttgttatttttctcttctacctgtatgttttaatgcagtctgttaaaattttaatgtatttttttaaaaatccaaaaaaaattgattcctggtagaattttaaagaataaaacttcataggcagtttctcaattaatgtaggaatactaaaatcatgtaatttcctgttcatcaatactagaaatggcaggcatagaactttaatctagacattagttttgttttcctgaatattaatttgtctttgtataattaggggaaaaaggctttcggctggattcaccccaaagccagtgctctttggggattttcagagggaacaccgtggaccactgaggatagagggctgcagttggctgctcccttacttttcttccccagtggcatgaatttaaaacttatgaaagcaaaatgcccatctagcttgtcaagtcgagagtgacttcagtatgaagaaagccaaagtgccccctctaaacagtggcacttgcccgtgaaagacacatgcttctcagcctcagagctgggctgtggtgagacagcgctgtctgttaatgtgaacttctatgatgtgacatgtgtaactgcacataactgcgtatgataagacacatagggcccaaagggagaagccacaggcacagccccagagcgtctctgtccttcaggccttgagtttctccctctgaaaaagcagcaacaagttctggtt

SEQ ID NO: 383452 - DNA, 136 bp, Homo sapiens
  misc_feature (5)..(6): n is a, c, g, or t
  misc_feature (44)..(44): n is a, c, g, or t
  misc_feature (122)..(122): n is a, c, g, or t
  misc_feature (125)..(125): n is a, c, g, or t
  misc_feature (129)..(132): n is a, c, g, or t
  misc_feature (136)..(136): n is a, c, g, or t
aaganngactttggttttaacaggatttctctggctcctgtgtngattgagggggcggggggcagtatacagcagggagaactttgggaaactcttgaaattattgaagtaagagacatggngtntggnnnntggn

SEQ ID NO: 383453 - DNA, 8502 bp, Homo sapiens
  misc_feature (3552)..(3552): n is a, c, g, or t
tgtcttaaagtaaatcttgttgtggagcggagccctcagctgagggtgcgctctgaaataatacaccattgcagccggggaaagcagagcggcgcaaaagagctctcgccgggtccgcctgctccctctccgcttcgctcctcttctcttctttacccttctcctctctcctcctctgctgctctctcctctcctccgctcttctctctcctcctctcctgctctctcctcttcccttagctcctcttcttttcttctcctcttcttccctctcctcgcctctcccctgctcctcttctctcgtctcccctcccctcccgcctctctctcccctctccctctcccactcgccccgctcgctcgctcgtctgtcgcacagactcaccgtcccttgtccaattatcatattcatcacccgcaagatatcaccgtgtgtgcactcgcgtgttttcctctctctgccgggggaaaaaaaagagagagagagggatagagagagagagagagagagagagagagaggctcggtcccactgctccctgcaccgcggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgctccacgtgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggcctggtgggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagtggctcagatcacattacgggagtttttcaatgccattatcgcaggcaaagatgttgatccttcctggaagaaggccatatacaaggtcatctgcaagctggatagtgaagtccctgagtttttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttntagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaacttaaaaaaaa

SEQ ID NO: 383454 - DNA, 8043 bp, Homo sapiens
  misc_feature (3093)..(3093): n is a, c, g, or t
ctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggagggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgctccacgtgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggtcattccgaaccccctggacacctttggcaatgtgcagatggccagttccactgaccagacagaagcactgcccctggttgtccgcaaaaactcctctgaccagtctgcctccggcctggtgggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagtggctcagatcacattacgggagtttttcaatgccattatcgcaggcaaagatgttgatccttcctggaagaaggccatatacaaggtcatctgcaagctggatagtgaagtccctgagtttttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttntagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaacttaaaaaaaa

SEQ ID NO: 383455 - DNA, 8085 bp, Homo sapiens
  misc_feature (3135)..(3135): n is a, c, g, or t
gcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgctccacgtgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggtcattccgaaccccctggacacctttggcaatgtgcagatggccagttccactgaccagacagaagcactgcccctggttgtccgcaaaaactcctctgaccagtctgcctccggcctggtgggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagtggctcagatcacattacgggagtttttcaatgccattatcgcaggcaaagatgttgatccttcctggaagaaggccatatacaaggtcatctgcaagctggatagtgaagtccctgagtttttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaagaaaaataatcactctcaagccttgtctaagaaaagaggcaaactctgaaagtcgtaccagtttcttctggaggcaaagcaattttgcacaaaaccagctctctcaagatgagactagaaattcatacctggtcttntagccacctctctaaacttgaaaataggttcttcttcataagtgagcttacatcattcttcataaagaaaaatcctataacttgttatcatttttgcttcagatactaaaaggcactaagtttccaatttacgctgctcaactttgtttatatgcttaaaaggattctgtttacttaacaattttttcccctaaaatactattttctgaatacttccttccagtaaggaataaaggaaagcccaacttggccataaaattcttgcctacactagaagtttgttgacagccattagctgacttgatcgtcatctcctaagaggaacacatatattttcacaagcaattccacactatcctgatgggtatgcaaagtggtgacagtctaactcagtgtttcttcattttaggtataacattttaaagcaattgataatgcctcttccaattcagaagctagtattgaccaaaatgtgagaagagtgtatagcataggaaaatttggggttaacccaaaagacacaattccagcacacataagaaagctagctgctattttatgctttcttccatggttctcctcttttttcccttttatttttccctgtttttcaatgatgtacagtgttccctacttgcattgaaaaaactcgtatggcattcacactttttttcttaggtgggtttttgtgtccagatgcagtaagaattcattgttcatcctaaaactgttttccagacccttccttccccttaggtaatttgatatacacctcctaaaatgacacagtaacaaatctggtatttagaacatatagaacataaatgccattttttaattcaactttaataagaattacatttgactttggagaatacaggtcttgacccatgtgactgactagctgacccgatcgctgtaatttaacgtcatttataaattctgctgatggacaggaatgtatgaactcaattattgtcagcacaaagccttaaaacctgctgactttaaattaaatggtgcagtcctatgatgccctgcaccatccaggggactaacagggcctcgcagtgtagacagagggtgcagccacacgggcgggggcaccagccacctcactctgcacccgcggcctcacacatctcccagctcacactctactaatgcacagagtcattagatccaatttgttatttttctcacttgctttaaaaaaaagcagtttggataatcatgacattggaataaagtgggaaggaaaaattccatcagcacaaaatagggaagtaatcccaacttgtagtcacagttttctgactggctttgttttaaaagaggatggcagtccttgttcgtgtcagtgtgccactgggtttttgctgttccgtgtaattcatatcaactttgtgttgccatttgcaaggtaaaaggcaaagctgtagtgtattcacctatgtagacagattgctagatatctttttgatctggggcgagttcaatattgattccagacttatttggatttttttagtattattttcccctccctttctaatttaaatagacaaattaagcaaaagtgtgtgttcacaaccaaatgttgatgcccttatctactgataatatcctctcaatgttcactgaggcatagaaattatttcagagtagaaattgcagcatgaggataaactcacctctttgttctgaaaatagaactttatcactatgctttccggtggttttcccttttacaatcgaaatcttgtgcctcccaagtgcattggaaaatgacaaaagcctgtctctccaaattcctatttaacagtttgattttttttttttaatcaccatctttcaaatcttagctcaactctcaccaagtgaaaattggctacttgggagaaagttaactttctatggtgggatggtgaaggatgagggacagtttacataggaaaagaaaaaaaaaagtctaaagtccatgttgaaaaaccacactaccacttattttctgctaaccctaaattatttttgcgtatacgcttgaggttatagtctgtgcctagacctaaaatgcaccagcgggggggattttaaaaaatccttcaaaataccagttttttcccaacaagtacaattgttcttgtgccttctgtggctttcgatttcatctttttgactttatttccaattactacagctgcaataaacactagattttttttctggctgtttgacataacgttgatagctatgcatattttgtgtctttttaaaacaaagcgggagaatacgtttttgaagaagagaatttttagaacagtttgataccgcaaattattttttcctcaattgtttgagcagcattcgagttttgaaaattcttgtagaagccaattttttgtaactgtggtgcaaatcttgtgttttcttagcctaatgaaaagtagtatagaagcaatatttcataccatgtgctatatatgtgtgcgcagatgtgtgaacataaaatcacatacacacatatacacacatgtaaaaatatacatatatatatatgcgtgtgaagtggaaagcttaccttttcctatctagatttaagaacctattttagacatttgttatgttttgtgaaaagaatgttctatttgcaacaaaacatttaattcttactgtatctctggctgtttaatgaggacgtttcacattaaatggtaaaacacatggaagatgttagaatgtagtaattatttaagtaaacgttcacccacatattcctgaagtttgctttgtgcctccgagtattatttaattaaagaagtgttttatgtttgcagaatctttgtcactgtactagggatgtgggtgaatatcatttaaaaaaatttaaaacaacaaaaaaaaagcaaaacagaaacactaaagcaagaggggaacttttataaagcaatgtaaatatttaacctcatggctgtcattatgtaagacatgagattttaataaataactacattctcacgacatctgttgaatttactaggaacactacagtgactgtatagacagttgaaagcattcttgaaaatcctgctctctccttttaaaagttaacaatctcttttatcagatgtcaagggcaagggtaatgcagtttctgtaaatttatgaaatttctttttctatgtacatgaagacatttagtaagtaacacccccccttcccatgcgcacatgtgcgcatacacacacacacacacacacacacacacacaaacacacacactgtcataaagctaatgatttggggactttaaaaaataggatgtcctccaggaacaatcataaatttatgaaagaaagagtagtttacagactcccctgaaagaagcagtgtatatgtgaagacagtgcaaaaatctctttgccatgtatattatagcgtattcattggtgtgaatagtacaaatgtttccttctggtacaaactctgtgtttgcaaatttacaagaagcattgttttcaaaaagctccccttaaaaaatgtaactggtttatatgagtaagcagttaccgtattgcacttaaatgttatgttgaaggaaatgcagttttgttttctgtagatctgttggttgtaaaccatctataaaactaaagctaaaatgctcatattcagagctgggatcaaaactggtatttaacctttgcatcttcttataattatccttctaagaatataacagaatgtggaagtgtctggactttgagtcttttcaactgagccttctctcaaatctgacaccccctcagaatgcacaaacataagcagaaaaggcaaacaagcttaccttcttttgtgaaaacgtattcattctgtatttttttaaatattcaattcccctaaaaatggggagaaaatattttaaaattgtatattacgacttcaaatttagaactaagaaaaaaatgtatttgggattggtctcagcgctacctagaagaatcaaaggtcatggcttccctcaatattgtcccagccatttctcatatgtatatagtataaaccgtgacaaaacactgcctttatattatttagcaatatgttgtaaatagcattattaagctcttttttgtaataaagaccctttgatttgaatatagtacaataactgaactgataaagtcaatttttgatttttgtttgttttttttagctagaggcaatttcaattgtgaatttttgttgttgtctattgttctgaagactttgcataatttattggtttaatttatcctaatttatttgatgaaggtgtacaattttgtattaccaaggatgtactgtaatattaattgatatgataaacacaatgagactccctgtccatattaaaaagaaaataaaaaggtgcagtagacaattgattttaaaggaaaagttaaaaaaattagtttggcagctactaaattttaaaacaggaaaaaaaaaagttgttgtggggagggtgggaaaggggttttactttgtgtgttttaagcttttgtatactctccaaacttttaccttttgctttgtaccacttaaaggatacagtagtccaattgccttgtgtgccttccatctcctcttaaactgaatgtatgtgcagtatatatgcaagcttgtgcaaaataaaatatacattacaagctcagtgccgtttgattttcttaaagaaagagtgacttttaatttttggacctgtatccaattgtaggacagtaggctagttgtgccagtaatgtcaagtatggagattttctttcactacaattcttcattctgttagcctaacgtgcagctcctagaaacaacctcttttactttagatgcttggaataattgcttggatttctctctctgaaacatctttcaggcttaactttatttagccctgaaacttaaaaaaaa

SEQ ID NO: 383456 - DNA, 2147 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactct

SEQ ID NO: 383457 - DNA, 4114 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaa

SEQ ID NO: 383458 - DNA, 3994 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgactatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaa

SEQ ID NO: 383459 - DNA, 2911 bp, Homo sapiens
caaatatactattttccactcattatttcacaattgtctaccaagttaaaatgaagaactttgtcaggtactctgcaaaggagggatgggcagagggaatatttcacaaacttaggccaggggcctaaaacatctctggcctaaggaagagaagcctataaggatctttaatactttaccctttaacactctgggtaggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaa

SEQ ID NO: 383460 - DNA, 1661 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccaggtaggatctggagccatgactggagtggtcctgagtgtctgctggaagtagacatgttgagacccagcttctaccctctgtaataaggaccataatattgctaatatttatggcatgtttatacagactaggcattttttgaggtgctgtacgtatgttatctctttttgttctgtcagcagccttatgaagtaggtaatattattgctcttttacatttggagaaactgaggtacagagaagttaagattcttacttgctttaggtccctcagatggtaagtggtgtgactaatatttagacccagaacctgcactttgaacccactctgctctgtgcctctggtagaaaacagccaccttttacatgagcactcactgggccctctcaagttgaaatgtgtgttattcacagcagtcttctcattttgccctcacagccacccatcaaagtgaataggaaaagtaacttcatggtagcaaagaggtagtgggcctttcctaggaaatagggctggtctaggggcacaaacttggtattagactgggaaaaagaaaggagaagttcagtttcttg

SEQ ID NO: 383461 - DNA, 1014 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatggcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggtgcaacgaatcctctcatcctctggactctccttgcttctccagagaccctttttcttgcctcactggaagccctggaatttcttctatgaccggca

SEQ ID NO: 383462 - DNA, 2027 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgactatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactct

SEQ ID NO: 383463 - DNA, 4179 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggcatgagccactgcgcccagccacaatctgaaattcctttcttgaaatgtcgcttatatttctctccttcctagcattcctaccttaggtagggccttatcatttctcactgatcaaaggcagtagcctcaaaactcatttctattactccaatcagccctaaattcttccattctcccccatcctctcatgccaccccttat

SEQ ID NO: 383464 - DNA, 4289 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatggcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgtaagtgctaagctggagcagctgagtgccaaggattttgtgaatgaagccatctcccactgggaactgcagtctgagggtggccaatctgcagccccatcccctgcctcctgggcctgcagtccgaaccttcgatgcttcacttttgacagaggggatatcagtcgcttccctcctgccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaa

SEQ ID NO: 383465 - DNA, 3777 bp, Homo sapiens
cctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcgcaaatctgcttctgcctacaagcctggtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttgggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggctgccacagagcccaaattccctgctgttcgactggctttgcagaattttgacatgacttacagtgtgcagtttggagatctttggccatcaatccgtgtcagtctcctctcagagcagaagtatggtgcactggtcaataactttgctgcctgggatcatgcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgctggtggatgtgccctgtaccacagaccgccactcccttcatgaggaggagaacaacatctttaagcggtcaaggaagaaggagcgacagatattgcctgtgctgcaagtgcagcttcttgcggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtaataccaaacctcatggccaattttggccccatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattaacccctaccccatctccaggcctgtactaaagtttgctgcccgcttaggggcttagaaggagaagccagtgagcaggctcacactaagttgtaaacataggagaagcatttggccaataaagttgttgaaactctatagacctggggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgtttgttttgtggattccagacttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaa

SEQ ID NO: 383466 - DNA, 1366 bp, Homo sapiens
taattttttgtatttttagtagagactgggtttcaccgtgttagctaggatggtctcgatcttctgtccttaaaatccacctgcctccacctgccaaagtgctgagattacaggcgtgagccaccacacctggcctgttttttgtttctttaacaaaaagttatagaaatttctctgggtattgtgttgaatctacatcacattcagttataatcatttagcaatattattccattcaatatggcttgtatctcttatttgcacatgtttttatcactttgatcaatgtttgtagatttgaaggtagaaacttctcaacttttttcatttattcctaagtatttcttactttaagttctttagcaaatgaaagtgtttttttaattttctttttaaattgtttattgttaatgtatggaaattcaactaatttttggtgctgttattctattcttcaaatccactgcatatgttttttagttccagttgcattttggttgactctttgtgattttctacacagaagatcatgtcatctacaaagaaatagttttacttctttctttctgatttggatgagtttgatttcttttgctatttcattgctctagctaggacagccagtattgattgaatagaaggggtgagagcattcttgcatcatgtgagatcctacaggaaaagcattccattttccctgactggttatttctgctgtggtcatttcatggatggtctttgtattgttgaggtaaatttccttctctttctattttgtttaggatttccatgatgactggatgttgaattttgtgaaatgctttttctccatgtattgagatgatgtggttttcatctttcattatgttcaagtggtatatcacattgatttgcttgactatgttgaaccattttgcatcccagaaataagtggcacttgcatatcaacaatcctttttataacctcttgaatacagttcgctagtacaaggggtcttcaggaagttcatggaaaaatacatattatgagaaaattgtgcatgatatcacattttttgcaccaagataaactggtacaaatccgttataacatgtctgaacagggtttggtttgaggcactcagatgggtaagacatgagtttgaaaagagactcaatcaaggcaatgtaaattctgctaaaactgaaacaagaagaaacatcaaatttgcgatgagaccagatgctgtggctcaggcctgtaatcccataattttcagaggctgagacagttgggtcacgtgggccccggtactcaagaccagcctgggcagaatggtgaaaccaccttctctacaaaaaatacataaattagctgggcattgtg

SEQ ID NO: 383467 - DNA, 154 bp, Homo sapiens
tatctgtgtgtgaaaactggggtagacaaaagctggaccccaaaacaaactgtcaagggaataagttgaactatgtcatttattatacactcaaccaaacccaggtgcctgcaatgtactagataaagttctagtctcagaacatgattctagg

SEQ ID NO: 383468 - DNA, 851 bp, Homo sapiens
tagtttttttaatggtgctaatacccctacctttcagggttgtaaatgaaaagatgttaaaaaaaaaaatacctgacatatagtgggtgttcaataaatgttagttttcccaaagacagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgagaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatcttggtcgtgtcccagaggcctctgttgatgtggcccaactgagctggcaagtgagaaaacatacacataaatacccatgatctcagcgattctctcccctccccaggacattccttagcagaaccaatctctctcactcggctggagcctctctgttcacagataggcctggctgggc

SEQ ID NO: 383469 - DNA, 479 bp, Homo sapiens
gacgaagtaatttatgaacaatagaaatttttcacagttctgaaggctgagaaattcaagatcaaggggcatcggcattcagtgtctagaaagggccttttttctatatcctcacatggcagaagggggaagggcagaaaaggcccaagttctttagctgtagcccttttataaggcactaattcattggtcaattcccaaaaggccctgccatttaacactacctcaaaagggattatgtttcaacacatgaattttggggaacattcagaccatagcatgtggcattaagtatattcacattgagaatatgtttatatttttctgcagccatcacctgtatccacctgcagagttttttcatcttccttaactgaaactctacccattaagcattaactccccattatcccctatccccaggccctggcaattactattctattctgtgtctctgtgaatttcactactctaggaac

SEQ ID NO: 383470 - DNA, 615 bp, Homo sapiens
ttcaggctaaccttgtgttagcattctttaggatcctcattgttcagctgaatgagagcctaaatccatcctattatgagtaattaatgggctatataatagtgagattaacggagtccctccctattcctagacttcacctttggcaagattttcatgtgtacagttttaatcaggcatgacaagaagatacaaaagaaacagaaaatcacagcccataaaaagcaagttacataataatatgaataatacaatcctatttatatctcacatgcatgcattttttaaaacaagaatgagatatatagaaattgcctggaagaaaacacatcagactgggcgcgatggctcacgcctgtaatcccagcactttgagaggccaaggcaggcagatcacctgaggtcaggagttcgagaccagcctggccaacatggcgaaaccctgtctctactaaaaatacaaaaattagccgagtgtggtggtgtatgcctgttatcctagctgcttgggaggctgaggcaggagaatcgcttgaacctgggagatggagattgcagtgagtcaagatcttgccactgcactccagtttgggcaacagagtgagactccatctc

SEQ ID NO: 383471 - DNA, 550 bp, Homo sapiens
gtttgtgattcacaagggacaaaacaatggcacatgctgggtggttgtcagctttccaacagatctgaatcccagagctgtgagttcctgctctgcctacccaaactcataaaaactactgtagagccttctgaaatgtgatatttctccaagccagagaacaagattcatgttggggatttgtccatgattgccatttaacagttttgtgacagctaaagcaactccctcttggttgctaacccaccatgttgacttctgattaactccagttccagaaatgcctctaagatttctattttatctactgttccttgtgtaagagcatgtactaactgtaaatcttgcccataaatcctgcccttaggcagatgcacatagcattcttgccttttcctacgattgtgctatatattccttccctatggtatatgagctctgggttttggagggtgatggcaccaagatccaccatctagactcacagccacccagcactcagacatggcttctgtttgcagcaattaaatgtgtatgttttttaaaaaat

SEQ ID NO: 383472 - DNA, 356 bp, Homo sapiens
cggtaccctctcgttatgcagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtctgctgaggaggggctcagaggacggagctctgcatccggggaggagccgtcaggcgggataaagggaatggttctcgaatccgggctgggtcctccccgccgagtg

SEQ ID NO: 383473 - DNA, 6305 bp, Homo sapiens
caatggtcgcccggcgtgtttggggcgcctcgcgcgtgcctccggcctccgcccgcccgccgcccgccgcgtgttccggagacgccgcggttcgtgggccaaggtcgcccgggcgctgtttgcgggccgccgcggccgcggatgagccgggacacgcgggctcggccccagcggtggcggaggcggcggcagaggagacgcgcgggggcgacatgccggaggcgcccgggacccccgaggccttgccgccgcgacccccgccgccagcgccggagcccgagggagcgcccgctactcgcgcggtgattcgcgtccccggcgccgcggccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383474 - DNA, 6109 bp, Homo sapiens
caatggtcgcccggcgtgtttggggcgcctcgcgcgtgcctccggcctccgcccgcccgccgcccgccgcgtgttccggagacgccgcggttcgtgggccaaggtcgcccgggcgctgtttgcgggccgccgcggccgcggatgagccgggacacgcgggctcggccccagcggtggcggaggcggcggcagaggagacgcgcgggggcgacatgccggaggcgcccgggacccccgaggccttgccgccgcgacccccgccgccagcgccggagcccgagggagcgcccgctactcgcgcggtgattcgcgtccccggcgccgcggccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtctgctgagagaggggtacgcgagctg

SEQ ID NO: 383475 - DNA, 5703 bp, Homo sapiens
caatggtcgcccggcgtgtttggggcgcctcgcgcgtgcctccggcctccgcccgcccgccgcccgccgcgtgttccggagacgccgcggttcgtgggccaaggtcgcccgggcgctgtttgcgggccgccgcggccgcggatgagccgggacacgcgggctcggccccagcggtggcggaggcggcggcagaggagacgcgcgggggcgacatgccggaggcgcccgggacccccgaggccttgccgccgcgacccccgccgccagcgccggagcccgagggagcgcccgctactcgcgcggtgattcgcgtccccggcgccgcggccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagaga

SEQ ID NO: 383476 - DNA, 6188 bp, Homo sapiens
ggttaggctaggtagaggccgggtgtgaatcggccgaggctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383477 - DNA, 5863 bp, Homo sapiens
  misc_feature (14)..(15): n is a, c, g, or t
tgggcggtcaactnnggctaggtacgaggcctgggtgttaagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383478 - DNA, 5255 bp, Homo sapiens
ggggagcattcgggccagagcggtcaaactctcgggccagagccgccagtgagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383479 - DNA, 5228 bp, Homo sapiens
cgccgccaccgccgcgccgagtccttttgtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccgccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383480 - DNA, 2016 bp, Homo sapiens
cgccgccaccgccgcgccgagtccttttgtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagccagcaggagggccacaccgaagcctgcggctcgctcaccagcatgcaccggtgcagcaatgtccaggtgacccagactccgcgcagtctgtgag

SEQ ID NO: 383481 - DNA, 1592 bp, Homo sapiens
gctggtacggccgggattttgggattgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383482 - DNA, 6400 bp, Homo sapiens
caatggtcgcccggcgtgtttggggcgcctcgcgcgtgcctccggcctccgcccgcccgccgcccgccgcgtgttccggagacgccgcggttcgtgggccaaggtcgcccgggcgctgtttgcgggccgccgcggccgcggatgagccgggacacgcgggctcggccccagcggtggcggaggcggcggcagaggagacgcgcgggggcgacatgccggaggcgcccgggacccccgaggccttgccgccgcgacccccgccgccagcgccggagcccgagggagcgcccgctactcgcgcggtgattcgcgtccccggcgccgcggccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383483 - DNA, 6641 bp, Homo sapiens
cgccgccaccgccgcgccgagtccttttgtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383484 - DNA, 3125 bp, Homo sapiens
cgccgccaccgccgcgccgagtccttttgtccaagatggcggcgccgggggcgctgcctcctcggccgccgcctccgccgccgccgctgtgagaaacctacgggccgcccgcccgccgcgccagcgccatgaagcggcagagcgagcgagactctagcccgagcgggcgcggctcgtcatcgtccgccaagcgtccgcgggagcgcgaacgggaggcggaggcgggcgggcggcgggcggcgcacaaggcctctggcggcgccaagcacccggttccagcgcgggcccgcgacaaaccccgcggcagcggaagcggcgggggcgggcatcgcgacggccgcggcaccggggacgcgaatcaccgcgcgagtagcgggcgctcctcgggctccggcgctggcggcgggggacgcggcggcaaggcctcgggggacccgggcgcctccggcatgtcgccccgcgcgtctcctctgccgccgcctccgccaccgcctggggccgagcccgcgtgtcccggctcatccgcggccgcgcctgagtacaagacgttgctcatcagcagcttgagccccgcgctgcccgccgagcacctcgaggaccggctcttccaccagttcaagcgcttcggcgagatcagcctccgcctgtcgcacacgcctgagctgggccgtgtggcctacgtgaatttccggcacccacaggacgcacgcgaggcccgccagcacgccctggcccggcagctgctgctctacgaccgcccgctcaaggtagagcccgtgtacctgcgtggcggcggcgggagcagtcggcgaagtagcagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggattttta

SEQ ID NO: 383485 - DNA, 5864 bp, Homo sapiens
aggggagaaaaaaaatcggcaggacaggggctgggtgttatagcagcagcgccgccgcttccacgcctcccccagggccgcccgcgcccgccgacccgctcggctacctcccgctacacggaggctaccagtacaagcagcgctcgctgtcccccgtcgctgccccgcccctgcgggagccccgtgcccgtcacgccgccgcagccttcgccctggatgccgctgctgccgccgccgtgggactgtcccgggagcgggccctggactactacgggctgtacgacgaccgtgggcgcccctatggctacccagctgtgtgtgaggaggacctgatgcccgaggatgaccagcgggccacgcgcaacctcttcattggtaacctggaccacagcgtatctgaggtggagctgcgaagggccttcgagaaatatggcatcatcgaggaggtggtcatcaagaggcctgcccgtggccagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383486 - DNA, 5430 bp, Homo sapiens
ctgaggtgactctacaggatcttaaaggctggtctgggtcagggcggtgcctatgccttcctcaagttccagaacctggacatggcccatagggctaaggtggccatgtcgggccgagtgattggtcgcaaccccattaagataggctatggcaaggccaaccccaccactcgtctctgggtgggtggcctgggacctaacacgtcactggcggctctggcccgagagtttgaccgctttgggagcattcggaccattgatcacgtcaaaggagatagctttgcctatattcagtacgagagcttggacgcagcccaggccgcctgtgctaaaatgaggggttttcccttgggtggaccagaccgcaggctccgcgtggattttgccaaagcagaggagactcggtacccccagcagtaccagccctcgccactccctgtgcattatgagctgctcacagatggatacacccggcaccgcaacctggacgccgacctggtgcgggacaggacgcccccacaccttctgtactcagaccgagaccggacttttttggaaggggactggaccagccccagtaaaagctctgaccgccgaaacagccttgagggctacagtcgctcagtgcgcagccggagtggtgagcgttggggggcagatggagaccgtggtttgcccaagccctgggaagagaggcggaaacggagaagcctttccagtgaccgtgggaggacaacccattcaccatatgaggaacggagtaggaccaagggcagtgggcagcagtcagagcggggctccgaccgcacccctgagcgcagccgcaaggagaaccactccagtgaagggaccaaggagtccagcagcaactccctcagcaacagcagacatggggctgaggaacggggccaccaccaccaccaccacgaggctgcagactcttcccacgggaagaaggcaagagacagcgagcgcaatcaccggaccacagaggccgagcccaagcctctggaagagccaaaacacgagaccaaaaagctgaagaatctttcagagtacgctcagacactacagctgggttggaatgggcttctggtgttgaaaaacagctgcttccccacgtctatgcatatcctagagggggaccagggggtgatcagcagtctcctcaaagaccacacttctgggagcaagctgacccagctgaagatcgcccagcgccttcgactggaccagcccaagcttgacgaggtcacacgacgcatcaagcaggggagccccaacggctatgcggtcctcttagccacccaggcaacccccagtgggcttggcactgaggggatgcccacagtagagcccggtctgcagaggcggcttctcaggaacctggtctcctacttgaaacagaagcaggccgcaggggtgatcagcttgccagtgggggggtccaagggcagagacggcacaggcatgctctacgccttcccaccctgcgacttttcccagcagtacctccagtcagcactaaggacattgggcaagctagaagaagaacacatggtgatagtcatcgtcagagacactgcctagcccaagcctgtctttcccagcgtcatgtttgtgtcacaaaagcagttattttaaaatctgatcccctctctaccctaccactttggtttgaattatctcctgggttattttggttcatttgggtggggatcaaagtcctgtccaccaccaaaactaagttcttagattttgggggatttttttttttaaacgatgagaagggaatccggttatgttgatttctagtgtacaagatactgtctgctgtggttctgtatttttttattttttgaccaactgtatggaaagttgtcagtaaaacctttgacagaggatggatttttaaacctgttcagagtcctggtttaatcaatcaagctaaaagaatcgaagacatccctagtgcatgtacacgaatgccctacgtcatccttccagcaccactgctgcatgggtcactctcggcctctcaattcttcaggctcagtctggactctacttacactcatttttatcttggctgacagcaggcaagcttcagtttgggctgtggacgctgccacacaagcctgagtagagcccatgcaaaggaagggatggggtgagcgcaaggcctgtggtcagcagctactgatggttttttctgccttaaaccgtgtgtgtgtccatcatcatcagtttgagctgtggctgtttgtttgggacagagtgcccactcagcatgtttggcagcaggtagccttcagcagctgtgtagtcttgtacaaggagaagctgtgcactgttgatgccagggggtctcggggcccctgatctgtccaggctcctggttcggcctactttctagcctcactcagcccagggatagccagtgttgggagacagagttgcctcaggttcccaggggcccgggagtccaaatactggaatggagggttggaggcagccttccttggatttactcatgaactttgcctagttgtttgtgatttttggctttctctggtcgttcaggggtgatgggtaatagagcaggcccgtgtccagtcatacctagagatttgtggggggatactgaacctctagactgaagtacttaccggggagcacagtggactaggggatgcccttgataatgacggtttcctaggtgcaagatcagagcatgtgcctacaccttgtgccctgatgccgaggtggagaccattgggaaataattaatagatatttttctggggggaaatcacaagtcactgaggtgtttgtttgtttgttaggcagtgctagagcttgaagccactcaagccagttggggaggaaagggatgcggaggtaccctctagctgggaagaagggtgagattccgtcttcttccctgtctcaagtaagtaaggaaggtactgcggacagtgcgggccagggaggaaaaccagagcacacagttttgtcaccatggaacaccccaaatgccattcttcagcgtgtctggtaccttggatgttcaaacagggaacactgtcagggctgaggagaacagaagctctggtaagcgaatgagcccctagatgataaccaggaactccaggttctgctggccgtggcatcctctctccaggtctgctcccttaccggagctaggataaggtagcatgagtgacacctgagattagaggctggggctcactgcaggctgtggagaggtcatgctggtccacaggaacacttggcagtgctctcgtagacccctcggtgatgtggaatggacaggtgcctcgcaagagagcaagcacgttcataacaaaacagcaacacaaagacatgttaagcatgtttatttatttgcctgtttttgtttttttacttgagctgtggtcacagctgccaggtacctaagcaagtcagttgggtacagcaggacacgccaccattccagggtagctggtaccgccagaaacaggagtgggtcttgtcctgttgcaggcacactgcagtggttttcctgcagctctccaacaaacgcctgagtcacaggccagagctgccttggtatgttgttaagtccaaaacttcttctctgggctacctatcttccttcatgaagcaggtgctcaggacccggaagaatcatctacctcccagctttgtgagacagaaccaagtaaaaggaaacatgctagaaaacgtgcctagagaagacacttcaacctttgccttatccaacccctcttcagagaaaggtgtcccatggccccaaaaagaactgccaagttttggtgaggagtaacaccctggcatgacattccttctctttcctggccctcaaccacttccttcctttggctcttaagacctagcaggttctgtgaactctcaggccttggccagcactagttaggggaggtcaggtggtcaatgtcctggtgattttatgagactgccccactgagaaaacttacttacttcaggcatccagtgcccccacccagggttcaggccctgtctaaggtgttgcttaaagacaaaaaggcaacatgtgcctcactggtggtgtgccactgttctcatgctgcctcctaagtgactccgattttcagccctggtagaataaggaagacagctgatgcctccttagccccttagcacatgttcctaaggtgtgttgtcaagccaacctgaattctgcctccctgttatagtccctgtctcccccacagagacctgtgggtgctcccagcagagttgagactggctccgttgagttaatgactagaatatagtgctttcactacttgattgttaacctgttttcttctgatgccatcagtaccagcagtcagactattccactggttaagtgtttactaccattaaagcgaggcatgaagcaaagagctgagtgagtcctctgctctccagaggaccaagaaatacctgtgtgacacagacccacttcagtgtgtacagcaaattctatagtgcttctgagcccagcagggctttacctgcccctggagagttttagccgtcttgtgtttcttgtttacttcacaaccaaatttgtcccctcttctctctgttaagggagagaagtcactttagctggataatacctatgtaacaaactgagcagctgttatttgggcaaaatcaaaggaagaaagagactatggtcttctatttattgtgggaaggaaaacagggtggggcgggtgagtgaaaaggtggaaatccctggtaccttgcctggtggttacacagtttaaccataggccaattttaggggcctctgaagtatctttctacaaacgcagacaagctccactacccctaacctgccaggatgctcaagtccactgtcacaatccctttcagaaaacattagtggccgctgccccagctacagagacggccgaaatgctttcactccttagctttgccaactccatcctccaaaacttcccagaatacctccctttccagttctaccaaatctgtacttgggagcagcctgctggatccagaacatgacaacagagagctgcgtccacagggaacaaagccctgacctctctctccacattacccttacaaaaacaggccctccccatgagagagctacacggcaggggcagacactgtgagtataagctactttcctccctggagtgctctatgtgggcagaacatgctctccttgcctctcctggaaggtgtcttctctatggcctggctagagctgcaaaaaagggacacaccccacttcggtaaaagaaaatagggaaaggccataaacaaagacagacttgtagtttattttgtattttttttaaataaatacactttacattaaaaaaaaggcct

SEQ ID NO: 383487 - DNA, 439 bp, Homo sapiens
aattagggagtcctgttgtggctgcagctctaagctatgcccttctatgaacttcatcagtgtttaggctaatcttcatctctttctatctggcttcttctttctcaattctcagagtgtggaggggaggatgattaattatcacctgtaacctcttgtatcagtccgggttctccggagaaacagaaccctacctatatctgtgtatctctatctatctatatatctatacagatatactgtatagatggatggtatgtctgcagggacctgtgttttatggaattggctcacatgattgtggggactggaaaatatgaaatttgtggggcaggcacagcctggaagttcaggtaagaattgatgttgtagtttggaatctcaaattcacagggcaggccagaaggctggaaactcaggtgggtttctatgtcacagt

SEQ ID NO: 383488 - DNA, 328 bp, Homo sapiens
tggaagccgtttgagaattcagaagtcgcttgggatcctgcaatatctcatccgtgtaagtctcagctgcagtttatccattgcttaaagtcatatgcgtggctaataatcaggaactagttactttcctattatattagctcaaggtattattccttaggtaaaaatagattgtgtctcaccacagcaccacgggagtttattccagaacttactttccctcatatctcataatgaactgactgtatcatcacccagaacaagccagcgaatgaccatggcaaccttattttatggtctcccactatctcacaactaactatacagt

SEQ ID NO: 383489 - DNA, 5456 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383490 - DNA, 5309 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383491 - DNA, 5254 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataactcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383492 - DNA, 5306 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaagtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383493 - DNA, 5263 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagccatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383494 - DNA, 2348 bp, Homo sapiens
gatcctgtctcaaaacacacaaacaaaaaaaacaaaaaataggttgagtgttcctgatctgaactgcttgggaccagaagtatttcagatttcagatttttttcagattttggaatatttacatatacataatgatatatcttggggatgggactcaagtctaaacatgaaattcatttatgtttcatatatactttacacacagcttgaaagtaattttacacactattttcaataattttgtgcatgaaacaaagttttgactgcattttgattgtgacccatcacatgaggtcaggggtgaaattacccacctgtggcatcatgtcagagctcaaaaactttcagattttgggggcatttcatatttcagattttcagattagggatgctcaatgtgtaaagacaagtaataccatattaagggatctcgttttgcattggtcatcttcaggaagttcctctaacaagaaaaagtaagtagcttctagaaactggaaggccataatacacctggtagaattattatgtcaaattcacatttttaatcatattaatgaatggaatttgttgatgttcaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383495 - DNA, 4743 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggtgagaattcattcgttcattcgttccttcattcagcaactatttagtactgactatgtgccaggcattatattaaacacagaagatacaactcaaa

SEQ ID NO: 383496 - DNA, 3705 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaagatacgagtctcactgtgtttccccggatgatctcaaatgcctgggctcaagcactcctactgcctcagccttccaaagtgctaggatcacaggcatgagccaccacacctgtcctctatttattcctttattcaataaatatgcattgagtatcctatgtaca

SEQ ID NO: 383497 - DNA, 147 bp, Homo sapiens
cttttattttgaaatattctttggaagtagatacattataaataatctgcaaacagtcttcccctggaaactctgtataaatccaaattttctaaattacaggtaccattagcagacgaaaggagttcccatacaggatacccttag

SEQ ID NO: 383498 - DNA, 335 bp, Homo sapiens
tcaaattcatgttcctaaccggatctttttttctcaccccgtttctgagaagcaagtcaactgcctagataaaaagggaagaaccatctctagatggttgttcttctctcttgagaacatactgttagaagttaataaaaagcaatgtgtctactttgatcttttttgtttcaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacattttt

SEQ ID NO: 383499 - DNA, 371 bp, Homo sapiens
taagtgaggaaatatatgtattttaaatggaatctctcaagtgagagaaaaaaatcaaaagtaaaagaaaatatgtcatataaagacattgagccttatcttttcctttttcaacagatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacagtatgtatttatcctttattttctttatatatatatacagaatattctcaataaaaatgtg

SEQ ID NO: 383500 - DNA, 936 bp, Homo sapiens
cttagtctctcctgtacccctttcttttttagtctctcctgtaccatcctttctttaaatgtacccctgacccttttatttaacccaaggccctcacatccctctgctggttggttctcccttcctggtccaaaagcaagtccacttgcacactccagtcctcctggtctccccattgcctccagggtcagaatgaatgttgctgcctctgccctgatattttccatctattgctcagaagcctgttcctacaggaaacttcccaactaccagcaaattaaggcatctgttcttcctccctccaacatcccccaaacatattaccaatacatatttatctttaataatttcttcattaaattataagttatttgagagcaatgaactgttaattatttaaagacttcctggtattgtcaatagccatgaatttccattagaaccactgaaagtatctaaacttccaaatcacaaatcatttttaagtgtgttcaaagatttgctcattaatgattctgttctgacaggttccaaagcagctgaaaacagtttactcttatatttgtctgtttgttttcttgtcttatgtgccagcatcccactacagaggctacggaaactctgattacaaacgcatagtagcatgtgccaggtgagcctatttccacaaaggggagcatagactccaagttctcatttttgttaacgtattgtttctttacatattttcaaattttggtatgtccagaagatacaaaattgttcaattgtttaaaaatgcagaacatatatattcttaaattgctacttaccataaaaaacagccttggttttgctcataatagttttctctgtctgttttgtcttctgattcaaacagtgtaatattaattttttctctttcagagggatagaaatgtgatttaaaaaattagg

SEQ ID NO: 383501 - DNA, 5208 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaacctggatcttctaaggaagattcacagtttcaaccaataatattacaggggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataactcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagccatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383502 - DNA, 5259 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaaggtattatacttctttcatgtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaagatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaagtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383503 - DNA, 1857 bp, Homo sapiens
cttagtctctcctgtacccctttcttttttagtctctcctgtaccatcctttctttaaatgtacccctgacccttttatttaacccaaggccctcacatccctctgctggttggttctcccttcctggtccaaaagcaagtccacttgcacactccagtcctcctggtctccccattgcctccagggtcagaatgaatgttgctgcctctgccctgatattttccatctattgctcagaagcctgttcctacaggaaacttcccaactaccagcaaattaaggcatctgttcttcctccctccaacatcccccaaacatattaccaatacatatttatctttaataatttcttcattaaattataagttatttgagagcaatgaactgttaattatttaaagacttcctggtattgtcaatagccatgaatttccattagaaccactgaaagtatctaaacttccaaatcacaaatcatttttaagtgtgttcaaagatttgctcattaatgattctgttctgacaggttccaaagcagctgaaaacagtttactcttatatttgtctgtttgttttcttgtcttatgtgccagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtt

SEQ ID NO: 383504 - DNA, 2953 bp, Homo sapiens
ttatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagagtctcgccctgtcgcccaggctggagtgcaatgggaagatctcgggtcaactgcaagtccgcctgccaggttcaagcgattctcctgcctcagcctcccaagtagctgggattacaggcacacaccaccatgcccagccaacttgacagcattttaaagtgtcatgcatatcactatactgccatattttatttaatctttaaattttcagtgcatttccatcatatcaaaataagaaacaagtacatctgtgatattttgggcttagttcctgttaattacctttcctcctgagtgtgggttacactttcctatttctttttatctagtaattttggattgaatcttctactttattaataaaaatattataaagactctggattctattacatt

SEQ ID NO: 383505 - DNA, 361 bp, Homo sapiens
gtagcattttggctcaacttaccaaaatgcctgaatgagaggcaaggcacctgcattccaaactacagaacacttccttccttttcgaatgagatcagaatgttctacttgataattcccaattcgagcaattcatatacttcctttgagaagttcaatgctggccacagagcatatgcttgctgcccaacaccaaaggaagcttaccattctcagggcctgataaagtgttctttgagtagaaacggaggtctgttaagcaccgtgttctttttcttgtgcttcttagggatgttgagcattatgtcctacagaaatgctgactactcttacagtgtgtggaagggtggaagtgctagca

SEQ ID NO: 383506 - DNA, 710 bp, Homo sapiens
ttcatattttcagtacagacagggttttttcgtgttggccaggctggtctcaaacttctgacctcaagtgatccgcctgccttggcatcccaaagtgctgggattacaggcatgtgccatcatgcccagctgggattaaactttttaaagttaaaacaaatataaatatgttacagaactgagtacaatgaccacatgaatttttaggatgaaataacaaacttcaaagaagtttgtgttttcaatgtgcctctcccgtctctgtccatcaggaataagtcacccttcctttgctattaggaatattttgtagaaaagttttaaaagcatcggtatactataaatatttggtatggctggccctagctgtaggagatgggtttggattactggtgaggtggttaggtcatgaggagccctttatactatgcttaaagttataagcagtcaggagccattaaagggttttaagctgcagtatgaccaaatcagattctcattttagacagatcattgaaaggctacctaggggctggaggaaggaagtaaaaggccaaggaaagagaaaagtttgatttctgttgccctagtccactgagaaaggatttttttaaaaactagtgctataggatgatatgaaacaatacactatagatataataagtaaatttatatagtatacatacatgctagaaggtgataactgctat

SEQ ID NO: 383507 - DNA, 533 bp, Homo sapiens
gaggaactttctttatcttcaggcattacttctcttgaaaatgaaatatcttctaagcttgaaagcacggtctgagtggaactaattgtaaagtgggggtggtagtggggagagagaggcagcgtgagtagaaagaccatgttcaggtagagggaaaaaattcaatttcaacgtattgtccctttttatatctttgacattaaatgaatgcctttaaacacactgacattttgtaatattacaaaatgaacgtgcagaattgagcaatcaatacaaacagatcatctataaaaaaggcaaggaagcatatcaccaaacctacaagaaggactcacagtttgggggactagaaaatgctagaccattgcaataacttccctcctggtctccccattttcaggtcttttagctctatcttcttaaagcagggttcagcccacataaatcgctttcttacaaaccttccagcactttctgttaactgcctactgaaatgaaaacctctcaggctgggactcagtgaagttcctctg

SEQ ID NO: 383508 - DNA, 448 bp, Homo sapiens
gacctggccctgccctcaagctcccaagctaaagagagcctggccctccctcccactaggtttctccagagcctgctgcctcctggtttgggcttctactctattcttcccccacagactccctgcaatttactgcatcacctctagactagcaattacagatggagctcagaacctacttcctgagccttcctaatctcagcagccctgacagccacttccctcttaacactaatgcagctgcttattctgctgacattaaggtcagggcctggtccaaggaagaggacaggtacagcccaagctttgcacttgaacatccatgcttctgaccacctgccctgtgacgctggctctgtgccccagtccagaaaagacttctgcctactcctcctctgccctacccagttaactccctttccttccctcccttctgcttctcactcct

SEQ ID NO: 383509 - DNA, 515 bp, Homo sapiens
aaacaaccagatctcctgagaactcactcactatcatgagaacagccagaggggaagtccacccccatgattcagtcacctcccaccaggctccctcccccgacactccctgattaaaagttatgtatgggcttatacaatttcaaatgtaaaaacagcctatttacatatgttgaaacaataagattttgtggtatcactgtcccttaataattacaattcaaggtaagatttggatggggacacagagccaaaccatattatatacttttgtgatagcatagaagcatgcctttttaaatacacaaaagtctaaatttctgaaacatcaagttatccttggctgagtaaaataatttttcacttataagaggattcaccatagccttctctaaatagttatttcttcatttaaatattgttcaatttaccaaaaaagttaccaaaaccttcccaaaatagttattacaggaagtgaggtacatatatatcttttgcaccttgtatagaaatag

SEQ ID NO: 383510 - DNA, 414 bp, Homo sapiens
tcttaattctctggcaaaggaaatgcaggtaatagcacccctgttttactggccaaaagatgaagcaacaaaattgaactttctcaaaattgtaccatttgaaatgccatattactcattcctcatctgctgctattttactttttaaaatttgtaacggcgttgttgaaatataattcacataccatacaacttacctgtttaaagtgttcatccagtgctatttttgttacagttattattattctccactccccttttatcttccctttattcaagaacttttattatttctacagtaagaagaaagggcatgttagttgaaatttaattatatttaccattcaaaataccactagaaaaaccccaacagaaaagagatgcagatgcagaatgagttcaggggcctgttgt

SEQ ID NO: 383511 - DNA, 1180 bp, Homo sapiens
gcgagcggccgccaccacacccagctactcagcctcccgaatggctgggattacaggcatgtgccaccacgcctggcaaattttgtatatttggagagacggggtttctccatgttggtcaggctggtcttgaactcctgacctagtgatccgcccgcctccacctcccaaagtgctgggattacagtcgtgaaccaccacaccccgccagaggtgggacctttaagaggtgattaggtcttgagggcttcaccctcatgaagggattaatgccattatttcgggaattgattccttataaaaggatgagtttggcccctttccgtccagccacataatgcctgctggcatgttatgtggcagcaggaaggtcctcatgagatgtggcccctccctcttggacctccaaatctccagaaccaataaatcccagtttattatcaattacccagtctgtggcattatagcagcacaaaacgaactaagacactgtagggtccagccctatggggctaagcgggtgttgtccccatgtgcagagacgagagattgtagtaaataaagacacaagacaaagagataaagagaaaacagctgggccccgggggaccactaccatcaagacgcagagactggtagtggccccgaatggctgggcgcgctgatatttattgcatacaagacaagggggggcagggtaaggagggtgaatcttctaagtgattgacaaggtgaagcaagtcacatgatcataggacagggggcccttccctcttaggtagccgaagcagagagagaaggcagcaaacgtcagcgttttcttgtatgcacttacaagaaagatcaaagactttaagactttcactatttcttctactgctatctactacaaacttcaaagaggaactaggagtacaggaggagcatgaaagtggacaaggagcgtgaacattgaagcaccacagggaggggtttaggcctccggatgattgcggccaggcctggataatatccagccttccacaagaagctggtggagcagagtgttccctgactcctccaaggaaaggagactccctttcgcagtctattaagcaacgggtgacttcccagacactggcgttagggcttgaccaaggagccctcaagcagcccttatgcgggcgtgacagagggctca

SEQ ID NO: 383512 - DNA, 800 bp, Homo sapiens
  misc_feature (575)..(575): n is a, c, g, or t
atcaccttcctggtcacctgcaaggcctggggtctgcaccctcaggaggatttgcaggcactccttcataacagcaacccaaggtccgcagcagcggctggtcatccccagtgaaagagcagaactctccatatgacaacctggacaaggccttggtgacctaaccaattcatccaattgtcttctgtaaaaggagaagagtctcttaactgaatctatgtgctgtggtttgaaagtgtcccccagagttcatggattgcaaacctgatccccagtgtggcagtattggaggtgggacctttttatttttttctgagatggaatctcgctctgtcatcccaggctggagtgcaatggtgcgatcttggcttgtcgcaacctctgcctcccaggttcaaacaattctcccgcctcagcctcccgaatggctgggattacaggcatgtgccaccacgcctgtagtcccggctactcgggaggctgaggcaggagaattgcttgagctcaggaggtggaggttgcagtgagccgaggttgagccattgcactccagcctgggcaaaaaagtgagaccnttgtctcaaaataaaataaaattaaattaaataaaaaataaatcacactgggccataaaaatgaagctggtgtcagcaagtgtggtccaattatttacataggtgcagaaaacagtgcaatatccatataggcacttacgttgctttgtggaagttttcataagaatatcagatggggtggtggcggggtcaacgcctgtaatccagactttgggaggtgaaggg

SEQ ID NO: 383513 - DNA, 300 bp, Homo sapiens
attttatggcccatcatatggtctatcttggagcaagttccatgcactgttaaatagaatgtatattctgcggttgttggatgaaatgttctcatctgttaagggcatttgttccaaggtgtagtttaaatccattgtttctttgttgacttcctgtcgtgatgacctgtctggtgctgtcagtggagtattgaagttccccactatttttgtattactgtctatctcatttcttaggtctattagtaattgttttataaatctgggagctccagtgttaggtgcatatatgtgtagggt

SEQ ID NO: 383514 - DNA, 2746 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383515 - DNA, 3150 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacaggtaagagattccatgacaggcctgtcccaagggcactgtcactttctgcgcaccagcaggaataaagggatatgggaaggacctgatgtttatgctgtcttttctgtgaagcacagataagagaagagaaaccaagagatgtggcccagactggaaactcatccactggccactgtatttcctctagcaggtggagctgggctcaggccccctgcctaccttgacctcaaagtcacaaccctcatatgttaaatcatggccggcagctcatggtacagatttggcgaagggttgtggggagagtcatgaggcttgtatttccagaccatctaattgaatgagcagtggaatctccaggaggtacctgctggtcagtagaccccttcttcctcccctgcttgcagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383516 - DNA, 3039 bp, Homo sapiens
ggccctgccccccgctctgcctcggagctgctccgggcctctgcgccggccgaccctgctggccctcccgcgcgcaccccgttgggacaggcctttgggcgggagagatgctggacctgggcgcagcccagcgaactcggcctaggggagacggacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtgctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacaggtaagagattccatgacaggcctgtcccaagggcactgtcactttctgcgcaccagcaggaataaagggatatgggaaggacctgatgtttatgctgtcttttctgtgaagcacagataagagaagagaaaccaagagatgtggcccagactggaaactcatccactggccactgtatttcctctagcaggtggagctgggctcaggccccctgcctaccttgacctcaaagtcacaaccctcatatgttaaatcatggccggcagctcatggtacagatttggcgaagggttgtggggagagtcatgaggcttgtatttccagaccatctaattgaatgagcagtggaatctccaggaggtacctgctggtcagtagaccccttcttcctcccctgcttgcagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383517 - DNA, 2434 bp, Homo sapiens
acggggccgtcgttacacacgcgggaagcatgctctgaccatctaattgaatgagcagtggaatctccaggaggtacctgctggtcagtagaccccttcttcctcccctgcttgcagatacttcgttgaaagttgccaccctgatgtaatccagcatcttctccaggaccccgtgatccgagaatgccgcttaagaaactctgaaggggaggccactgagctcatcacagagactttcacaagcaaatctgccgtatgtggactcctgggccacccttgggtgggggcaggcatttaggatttcagttctctcaggtgtctttaacccagcacttacaacctagcagccctgctggttctaccctttacaacttcacccattgcttgataacagcagaattaaatgttgtgtgcacgttcagcacctacctctctcacagatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383518 - DNA, 3309 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaacaaaaaaaaaaaaaaaaaaaaaaaaaaaaaaaaaaaaaaaaaaaaaaaaaaaaaaaacaagagaaaaaaaaaaaaaaaaagaagaacaaaaaaaagaagaacaaagaaagaggggggcggccccgggacgccgcgacccgcgaggagatgcagccgacagcggacgcccgcgacagagggggaggtagacgacggacggggcacaaaacaaaagagagaccgaaaaacaacgtcacgaagcgagaagaggaggagagcagagaaagagaacaagaagcaggggaagagagaaacgaagagaacaaaaagaggagatgaagggaggaggaagaaaaggacaagacaagaggagagcgcggaaggaaaggagagagggaaggaagaaaaagaagagggagaaacagtggtaggagagaaggagaaaggcgaggagaagaggagaaagagcgaaaaggcagaggagaggggagaaagaagaaacgaaacgggaaggcgagggcgagagacaaaggagaaggaggacggcgagagagaagaaagagggggagcgggcacgcaaggaga

SEQ ID NO: 383519 - DNA, 2283 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccagcatcttcgggcctttggaccc

SEQ ID NO: 383520 - DNA, 1839 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccttgtgatatgccttcgactgacccctatattaccggctcgttg

SEQ ID NO: 383521 - DNA, 1226 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383522 - DNA, 1268 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacaggtaagagattccatgacaggcctgtcccaagggcactgtcactttctgcgcaccagcaggaataaagggatatgggaaggacctgatgtttatgctgtcttttctgtgaagcacagataagagaagagaaaccaagagatgtggcccagactggaaactcatccactggccactgtatttcctctagcaggtggagctgggctcaggccccctgcctaccttgacctcaaagtcacaaccctcatatgttaaatcatggccggcagctcatggtacagatttggcgaagggttgtggggagagtcatgaggcttgtatttccagaccatctaattgaatgagcagtggaatctccaggaggtacctgctggtcagtagaccccttcttcctcccctgcttgcagatacttcgttgaaagttgccaccctgatgtaatccagcatcttctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383523 - DNA, 337 bp, Homo sapiens
agtagtgtcgggcgatcttcagtccggagaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383524 - DNA, 466 bp, Homo sapiens
ggagccttttaaaatcactaagattcttcctgttgatcttccatacatgatcatttagatgctgtgtgctgggggcagatttctctgaaattcctgcatccctctggtcttgagatcattagtcaagctccctgttaaaggcggctcctgatgctggtctctggaatgctagggaggagctctccattgttggccaccagggtggctgggcctggggagggaagtgaccaaagcaggtggacccaggagaaggcagaggagggctggggagagagagcagaaaggggcatgtctgctggcttgggctttgcaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccag

SEQ ID NO: 383525 - DNA, 583 bp, Homo sapiens
tgttcaaatcccatctccttaagagctatgtgatcttggataggttagttaatctctctgtgtctcagtttcctcttctttcaggtgtggattatagtagttttgaggattagaggagataatgcatgtaaaatgcttagaacaatgcctgagacagtaagcgatctgtaaacattattaaaaatgatgtattaaatttatgtaagtcttataaaatttgctgtgattataagtattataaaaggagtatcttttcttctggagactaacatgggctggttcccccttcccggcaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttc

SEQ ID NO: 383526 - DNA, 2933 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccgtatgtggactcctgggccacccttgggtgggggcaggcatttaggatttcagttctctcaggtgtctttaacccagcacttacaacctagcagccctgctggttctaccctttacaacttcacccattgcttgataacagcagaattaaatgttgtgtgcacgttcagcacctacctctctcacagatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383527 - DNA, 2604 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtgctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383528 - DNA, 2776 bp, Homo sapiens
  misc_feature (2749)..(2749): n is a, c, g, or t
  misc_feature (2754)..(2754): n is a, c, g, or t
  misc_feature (2757)..(2758): n is a, c, g, or t
  misc_feature (2763)..(2764): n is a, c, g, or t
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcatctcggcgctttggcaccatgagttctatgtctggggccgacgacactgtgtacatggagtaccactcatcgcggagcaaggcgcccagcaaacatgtacacccgctcttcaagcgctttaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaaccancacancanncaaannacaaaacacaag

SEQ ID NO: 383529 - DNA, 2424 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaccctatatctacggacctacgtctcagggggaaaggatgcaaattctccagaatttcaagcacaaccccaaaattaacaccatcttcatatccaaggtaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaaggtgatcacgaaactcgctggcatggaggaggaagacttggcgttttcgacaaaagaagagcaacagcagctcttacagaaagtcctggcagccactgacctggatgccgaggaggaggtggtggctggggaatttggctccagatccagccaggcctctcggcgcctttggcacccatgaatttcttatgttttggggccccgaccgaacactggggttccattggaggttaccacctcatatcgcgggagccaagggcgcctcc

SEQ ID NO: 383530 - DNA, 2437 bp, Homo sapiens
  misc_feature (2264)..(2264): n is a, c, g, or t
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggctcccgatggccatatcttcttggaagccttctctccagtttacaaatatgcccaagacttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgattgaggaactccagaaacgttgcatccacctggagtaccctctgttggcagaatatgacttccggaatgattctgtcaaccctgatatcaacattgacctaaagcccacagctgtcctcagaccctatcaggagaagagcttgcgaaagatgtttggaaacgggcgtgcacgttcgggggtcattgttcttccctgcggtgctggaaagtccctggttggtgtgactgctgcatgcactgtcagaaaacgctgtctggtgctgggcaactcagctgtttctgtggagcagtggaaagcccagttcaagatgtggtccaccattgacgacagccagatctgccggttcacctccgatgccaaggacaagcccatcggctgctccgttgccattagcacctactccatgctgggccacaccaccaaaaggtcctgggaggccgagcgagtcatggagtggctcaagacccaggagtggggcctcatgatcctggatgaagtgcacaccataccagccaagatgttccgaagggtgctcaccatcgtgcaggcccactgtaagctgggtttgactgcgaccctcgtccgcgaagatgacaaaattgtggatttaaattttctgattgggcctaagctctacgaagccaactggatggagctgcagaataatggctacatcgccaaagtccagtgtgctgaggtctggtgccctatgtctcctgaattttaccgggaatatgtggcaatcaaaaccaagaaacgaatcttgctgtacaccatgaaccccaacaaatttagagcttgccagtttctgatcaagtttcatgaaaggaggaatgacaagattattgtctttgctgacaatgtgtttgccctaaaggaatatgccattcgactgaacaaaggtgacacttcgtttgatctgccggaagcaaatgtcctcattcagatctcatcccatggtggctccaggcgtcaggaagcccaaaggctagggcgggtgcttcgagctaaaaaagggatggttgcagaagagtacaatgcctttttctactcactggtatcccaggacacacaggaaatggcttactcaaccaagcggcagagattcttggtagatcaaggttatagcttcaagccgttctagttcacgtgatccgaactcgtggctggagaggaaatggcgtttcgacaagaggaccggcgtcttctcggcgcatgactgtcccagagaggggcgggactggccaacacgactggctgccaaatatgagcgcagttgatcactggggcacaaccgattaggaacgatccggtattcctcgtaggataatgtacactntgggaacgacatcagacaggagccgctctacactagaccacaacggtacacatacgcacggagtcacaaagcgaacgcattcacacaaccagccgatcacaccagcgcgcatgacgccgacgcaggagctaccgccgcagaggaccacccttacgacgaccacaggcacagac

SEQ ID NO: 383531 - DNA, 889 bp, Homo sapiens
ccccacttacggctagtagaggcccgtgttaatcggcacagggcccaagcagttcttggtggctattgcagagccagtgtgccgaccaacccatgtgcatgagtacaaactaactgcctactccttgtatgcagctgtcagcgttgggctgcaaaccagtgacatcaccgagtacctcaggaagctcagcaagactggagtccctgatggaattatgcagtttattaagttgtgtactgtcagctatggaaaagtcaagctggtcttgaagcacaacagatacttcgttgaaagttgccaccctgatgtaatccagcatcttctccaggaccccgtgatccgagaatgccgcttaagaaactctgaaggggaggccactgagctcatcacagagactttcacaagcaaatctgccatttctaagactgctgaaagcagtggtgggccctccacttcccgagtgacagatccacagggtaaatctgacatccccatggacctgtttgacttctatgagcaaatggacaaggatgaagaagaagaagaagagacacagacagtgtcttttgaagtcaagcaggaaatgatgcttaggcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattgaac

SEQ ID NO: 383532 - DNA, 577 bp, Homo sapiens
gggagcttccggattgagccggaagtccccccagagcggatgccgcggcgggcctgtgggagcggggtcatcttctctctgctgctgtagctgccatgggcaaaagagaccgagcggaccgcgacaagaagaaatccaggaagcggcactatgaggatgaagaggatgatgaagaggacgccccggggaacgaccctcaggaagcggttccctcggcggcggggaaccaaggactacaggctgcaaatgccgctgaaggacgaccacacctccaggcccctctgggtgctgtcagcgttgggctgcaaaccagtgacatcaccgagtacctcaggaagctcagcaagactggagtccctgatggaattatgcagtttattaagttagaaaaaacatgctgttgtctgcccctcagtcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtc

SEQ ID NO: 383533 - DNA, 479 bp, Homo sapiens
ctatgaggatgaagaggatgatgaagaggacgccccggggaacgaccctcaggaagcggttccctcggcggcggggaagcaggtggatgagtcaggcaccaaagtggatgaatatggagccaaggactacaggctgcaaatgccgctgaaggacgaccacacctccaggcccctctgggtggtaagcatgcccttagcttgggcagggcccaggagtgtgcggagcggcagctaaatcttgggcatcctcagagtcaaaactgacattcaggatactgcccctagaactggccgggagagaattttcatccacacacgttggaacagcccaaggcaacagcgagcagttgcgcacacgtgtggcggccggacctgggcttccaacagctctaacccctcggtttactctcactccttccccagccctaccccatgtagtgaatccttttatctgccgaataaatagcatttatcatgta

SEQ ID NO: 383534 - DNA, 342 bp, Homo sapiens
gacaaagggagggagaaagaaggaatgggggagggaaggcacaagatatttaaggaaagaaggacaaaacaccactgttttattgtgaaagtcacagacttcacctaaagttgggggcggggtggggaggggggcggtgactgaaagtaaaagcaaagcaaaccgaaaagtcaaatcacttgaggaaaggggcagtgggcagactataaagccagtgattgcacttattatataactatttctttcatttgccctaaaaataagaaaagaaggcaaaaaagcaagcccttattagactgtacgttgcaaatactttaagccaaagacttaggattgtcattt

SEQ ID NO: 383535 - DNA, 492 bp, Homo sapiens
  misc_feature (6)..(6): n is a, c, g, or t
cgtgcngccgacctactactactaaattcgcggccgcgtcgacgcctgaatactaaaattggctacttgtactaagcagtttcccgtgtttgttaagtagctaacatctgtgtggggttttatggttaaaggaattttagatgttttccacttaatcaagtcagttatgtgtttttttaaattctaatttttttgggcacagggtcttgctctgttgcataggctggagggcagtggcatgatcatagctcactgccgcctcgaaatcctgggctcaagtgttcctcccacctcagcctcccgagtatctgggactacaggtgcatgccaccatgcctagctaatttttttttttttgtagagatagtcttgctgtgttgcccaggttattctagaactcctgggctcaggtgatcctccagcctggcgacagagcgagactccttctcaaaaaaaaaaaagtcgacgcggccgcgaatttagtagtagaag

SEQ ID NO: 383536 - DNA, 405 bp, Homo sapiens
aaatatattggctcagtaacagaaaaaaaaaatagcccttgattaaaggtttgatctatcccacgtaagaaagattaaaagcaaagctagaaaagatcagatttgtttctaaataacttatctgcgtcctaaaacaaaactaaaaaatttttttaaatacagtaatgtattaaaacatactgaaactcaatacatacagagaaacgaagataagaataagaagtccaagtgcagcggctcatacctgtaatccaagcacttggggaggccaaggcaggggatcacttgaggccacgaatttggggaccagcgtggggcaacacagcagaaccctgtcttttacaaaaaaaaaaataattatttttttcctttttggtagagacagggttttactgtgttttttcg

SEQ ID NO: 383537 - DNA, 1266 bp, Homo sapiens
  misc_feature (1012)..(1012): n is a, c, g, or t
gaattcaggcaggccctgggacagtttgtctctgctccccccagtgttggggcctcagctaggaagactttaaggctgggagagatttgatgcctgggagagactcaatcactgtgtaaccgaacacttgcttcttacagagtccaattgacaagggtgaggtataatagaaagacagaatttattagccaaaaatagtaaagggaaagcaatcggattcctatccaaattaacggcttctatttttaggaagaaggcaggggtttaaaaagggaaaacttgataaggaaggcagacaagaactgggctgagtacagtgtctgtgtgtcttattctggtggctatcttgggtcctggtccacctggaccctgggctgatggcatttcaacaacagccaggttgttaactagctgtcttgaagtaatctctggaactttgcagctgggtctccagacttggtctgtgtgtctcaggattgacccctggaacttctaagaagacacataattagatactagtagacagttggataaatgtgaagggagtatatacaatgagaaagggagggatgtggactctagaaaaggtttctgcagtttgcttcaaggttatatctttaaacccaaggaaaaggggaaaaaatttttaatgcagtttgaagctaagctgcctggttacaactgggtactaggatcatctggaggaatcttcactcagctgtctggcaggtgacactgggacttcatctaggctgttggccaaacacctctccatgtggcctttgcttcctcacagcacagtgcctgggtcccaagaacgaccatcccaagaggacaagacagaaccatatcaccatttgtgatttgctcttggaagtcacatgatatcacttccattgtagtcacaggctcacccagattcagaataaggggacacagaacctctcagtgggaaccatctgtggcacattgtaagaggaacatgtgggatgagagatgttgagggttcatnatcctaaaacatcactttaatcctgtcttcccattactgaccaaaacaaattctggcattaaaggcactctacacttaggcctcaaatgcctttccttacttcctgtattatctcctccattcagatcagaccgaactactcagtcacccacacttgtcagactcattcttctcttgccctttttctcaaggaatccctctcttgacctgagaaattctacctctcacttaaaagtgactgttcactgaattcc

SEQ ID NO: 383538 - DNA, 670 bp, Homo sapiens
ttttttggtcatatccatttcagtctttcctatgctctttctctactgctcatttaagttactgttacaaaaaggtgctgctaaatgtaggatgtcttagtcatgttgtactttgggacaatgccacatttttaacatggtctgctatgcattcctgttaaacattcactgtcagctacactgaactgtctaacaaacctggtttaaagtaattcatataaaacaaataaagagctggcttctgcactgtttattagtagtagtattaattgccatgttagaaatgattcatgtagttgagactatattaaatattcaacacttcccagctgcagggcatctttcttggggcaatgctaaatactttatgttcctttagtaatcttcctattatgtctgattaaaaaaaaagatacctccacgtagataaaatattttattcaacgtgagctctagcagaataatctgggtcagttatgagttctggatcaagagtttaatttctgctgcgctgtacttttaactatttgtactttgcttcattatttaaaacatgacacagggttttaaagtaaatgtactcactgttgaacttaagtacttcttctgtttcatagaaatgttaatattaaatgttaaaatatatattaattttccctcacatttccct

SEQ ID NO: 383539 - DNA, 142 bp, Homo sapiens
caagtcaatacccataattaagtcaagttgccagccttaattatatttctctctcgctcgttcactctctctctccttccctccttccctctctgccccacccccgtgtacattatataccaattcattggagatatatata

SEQ ID NO: 383540 - DNA, 277 bp, Homo sapiens
ttactctgcccctctgaggctattgtggtcaccctgtcccactgccctggactggcttgggggccaggctggcatgatcatgctgctctaggctggcaggtggagcattcccagccccggttccaaggtcccccgaggcgctgacaacacttggagggagaccatgcaggctgggcttcctgaccacccagacccttcaggaccaccccccatcccaccccaccatggatgtggcaaaggccctgccttggcaagccttccccagaccctctgctct

SEQ ID NO: 383541 - DNA, 456 bp, Homo sapiens
taaggtctacacagctggaaacatccatttctgatgccagctacatcattccctgatgagaacagtgccagcagtgaacccctcaccactccccacacccaacccccacctcagtgtccccagggtattatcagttgtgtcagcctagagtctctgagtttggtctggctctgcccctcccccatccgtttagaaagaatctatttctgtttctctctctctctctctctcatgcctcaatctcatgtcctcctgctgactctaaagagacagctgattgtgggaaagatttaaattgggttattctctcttaatataatttttgtaaaatactataaatgaatttcttcatggccgccaaagagaagtgctgctatttctagcaccagactgacaggaatggtgcctgttaggattaagttaagctgcaatgggaacattaaatatggcttaaac

SEQ ID NO: 383542 - DNA, 541 bp, Homo sapiens
caatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaatttct

SEQ ID NO: 383543 - DNA, 312 bp, Homo sapiens
ggggtgactaaaccttcagcttggttttactaaaaaagaaattcttgaaagaaatgccaccggtcacaaaattctatacacctatacctcttaagagtcaaaacactacatcatagagcaaatctgggaaaaccgtaacaagctatttcctgctgcctatcctaaacaggaggttaaatcctaaggctctagatgcaattctccgtaccgctgagcacctggaaccttcattttggaaactcatgaacttcagcgacactgccacgagggtttaataatgtcacccaactcctggactcacaaaagctacag

SEQ ID NO: 383544 - DNA, 115 bp, Homo sapiens
tccttgttaaacgtggccccttaactgatggctttcacagggaaaaagaaaccctacaaattactgttcttattttttaagttaaaaaaattaatcaaaataaaataatgccaaa

SEQ ID NO: 383545 - DNA, 885 bp, Homo sapiens
taacaataaagttttcttaataaataaaagtttataagcatagtaacaagtaacaaaatagagacaatctgaaaagctgtcataatagcaaatttgtatattttcctatttcattctgttttttagttttttttgtgcaagtaacactaggcatgtgaaggtaatgatgagtggaaaccatgtggggaggaggcacgagccatgcctcctccttccagtcaggatagtatcagtggaagcctaatgggaacctagcactcccacctgctacccagcagtaatgagtagcctctcccatttttgagtgtcaacagaggccgagttgggaacctgaacttctatccccatatggcagtaatgaggtagtatctccctttcttctgatggagcagtattaggaaaagccatataaaacaaaaaatttaaacaagatccagtctcttaattctcaaaatatccagatttcaattgaaaataacttataaagacaatctcaactaggttgaaaaaggtaatcaatagacaccaacaccaagataacagagatgttctaattatctgacaaagattttaaagcagccctcgtaaaaatgcttcaacaagcaattaggaaaatacaacaagtgctgtaaggaaagtacaatttgaatgacagcgcatttctcactagaaaccatggagaccagaaggaagtagcacatttctcaagtgctgaaagaaaataactgtcaagcaagaattctgtttctagtgaaaatatccttcaggaatatgggagaaaatcaagacattgttaggtaatggaaaacaaagagaaattgtcatcagcagagctgtcctagaagaatagttaaaggaagttctttaaacagaaaggaaatgata

SEQ ID NO: 383546 - DNA, 745 bp, Homo sapiens
aggggtttcactatgttggccatgctggtcttgaattcctgaactcaggtgatccgcccaccttgacctcccaaaatgctgggattacaggcatgagccaccgcacctggtttcttaacattctttgccacctcctctgctatatctatttactttgtatccaccagatcgaaagctcaggtctaattccctgtacctagaatattgcctgtagtgtagtaggcacttaaggttttgttgagtgagagaatgaataaacaaacagaaggatttgcttttcaaaccagagcctccctgcctcctgctctgcctgctaaggatcaggaggagacagcagctaaggaaggcagtcctgaattttccctagggatagggagtaagtggggggatccctgagaaacgctggaagcacccactctgctgccaaggctgcgaggaaaacaggccagagtatcctaacagcctccactcagaaggggcctggaaacttttaaccagacaaaataacaaatgcagtggtttagggcttggtggggcttcccacccgtcccacccctgtcccacacacctaggcccacattgaatgccctcagcacctccggctgcacaggggcctgttttccctgactctgctgctgttcacagaaccaacttcctcccaccccacacagacgctcccttcccagagctcattgggaaccttctgatttgcatctccaaagaaataaaataaattccactaaat

SEQ ID NO: 383547 - DNA, 229 bp, Homo sapiens
tcatccttctccttctagaaagccatgtctctgtcagtatcccgccctcctcactaaagctgtcaagaactataaaaggtctgagattttgtcctactcaacaagctaacaagtcagcccactacagtttcatggaatctggtagaaaacatgacactcagagatggacagtgttttactgtagaaaggtcagtcaccagatatcaacattttggcaccagtttcttga

SEQ ID NO: 383548 - DNA, 430 bp, Homo sapiens
  misc_feature (26)..(26): n is a, c, g, or t
ttcggcacagcatggcagaaggcaanggaagagcaaagggatgtcttacatggtggcaggcaaaagaacatgtgcagaggaactgccctttatagaactatcagatctcgtaggacttattcactatcttgagaacagcatgggaaatactcgcctctatgattcaattaccttgcattcctgacccatgtaaatccctactctacattgccctgcataatggtcttgtagcattttctagttattactgctatttgtgaacacatctattctccttaactattaatagtataaacaatttgagggtagggcatactatattttattttttaacccttaggaccacaatgctatagtttgaatgtttgtgtcccccccagattcatgcattgaaatgctaatctccaaggtattgggagatgaggccttt

SEQ ID NO: 383549 - DNA, 168 bp, Homo sapiens
atatgtatacactgagttaagtagtataaatattttagagaaaattgatgtaaaatcctcaactcatttgatgctccctatcccaggacagtaaaaattgcccaatatttccttggacctccataaagaagcagtttttcaaaaaataaagtgtttggaagtttaaga

SEQ ID NO: 383550 - DNA, 426 bp, Homo sapiens
tagaaaaatgcatggaattcattatgagccattaaagaagcagtcagtaattactagcagtgagaacaatttataatataaacttagacttcttttctgttttgtagtgatgaagcttacctagatttagagaatccaatggctgtttgttgtattttcttgaaagaatcatttcaaattttctgcgcttatagaaaaaatactactactaaatcttcgagaaatagagcttagaatagaaaactttcgacatgaatatcattaaggctagagctccttcataatctcagtcttttgttagttaaataattagctctctttcatgctcttgcctaacattgcattttgctccatagagaatattgtgtgaatgagtttaaacattaattcacttgcctccatcataatgatagctgcatgtaatgt

SEQ ID NO: 383551 - DNA, 4161 bp, Homo sapiens
gaattccggttatcactgacactatataactctgccacttagggccatgtgaccttaaggaaggcacttcacctgtttgtgtctcatctgtaaaatgggaattatgatgatacctaccttaaaaagggttgtatcaagggagttaatgcatgtaaaacaatgagaagaatctttagccaattgtaagcataagtgtcaatcattattattagtagtagtagtacatttatttgtttggggtttattatctgtctcctacacaagaagataaccttcttaacgacaaagactttgttttgttgactactatattctcattgcaagaagagtgcctagcacatagtaagggcttaataattatttattcaatgaatgaatgaatgcataaatgacttcaagtcttcatcatcctttttccgtgacttatgggatttggctgctaaagttcatgagtgggtgaacatagtgtttgatgtcacagctgcacacacttggtccagcacccccatatgcctagatacaaagtgggcatcacttgtgttctttgttgtgcctcattctgatgaccttttcgcctgacattttcttcccacaggcctcatgaatggccaggctatgctccacttccttcaagttgttcatttctcttaatctcatgaacgtgaacctgtcctcaatttcattgccataagatctcctcttagtaggtgatgcctaattactctttccaattaacatgctattcaaatttgtctaatgtttcttccagttctaaaatttgatgaccactgatctgatgtgaccgtgtgattgtttcacaatttgatgtgtgtgatgatattagtatgtacaatacatgctgtttacctctatctagtaacaaatgtttacatttgttactagagtaagctttaggggtagaacttgagtctcaaagctcacgtcttgggaaaaaaaaaagatctggtattgatagaaccttgataaatcccttgttatagcacatgtttttgtttcccagaagtagggcaagagctctctggcttatccaatcagcttcttctcctgactttagtagagacacgggcttcattactgagctgggaatttaacttccctctgtcctatgaaaagtagaagattttcctaagagaaaccttcagtgagagcagaacagaaaaaagagcaaagaactaactgaaggagagggcaagaaatcagtgtagtgtggggcagcagaagggaagtgacaggtcaaagaaaataggagagaaaaggagagagagctacccaagtaaacaggaaaaggggaggaaatacagggcaaaagcagagagcaggggaattggcatgacaagaaagtggtgaaacacagaggattccaccagacaacagagagcccggtagagaagagtgggctaggataaagagacaggaaacaaatggattaagacatagagtagccattgtcagttacctgggtaagaaaagattggtggtctaaataaaatgcagattgttcatttacaattctgactgtttaaattatttatggtacaccttggtgcttcacttaatcatgttaagttacagttgtaatcttattaattacttgcaaccagctttctcaatgtaccatgtatagaggacagcttgtcaaggggtagaagtactatagcttcacttttaatccagtatcatccagtacacaaattagccttacactgttagaatcttcctgatgatgactggctgaactaagcattagtcttgacaatacaagtactgctgtgcccatttacagaaagggaagcaattctttcccagaaagtaagatatgatttaaatgctttggcctaattagctgtgaaaaaggacatggcccaggtaaggcttcaggaaaagccaattaacacatgtgcatatgtctctctccattcacatcacccagcctagtccaagtcaccaccatctcttcacttgcattgttacagtagtctcttagccgcttttcccacctccacctttgatatctctagttattcatgaggtccaaaatgacttttaaaaataacaccacactatctctatttagacttttcaacagtttcccactgcacaagggatacattaccacaagggaattacaccaacttgcccttgcaaatctcatctttatgttcaactgtgctgatcttcattttcctcctcagatgcgcaaatgctttcccatcccagggacttcatgtttgttctgccccaaaactaaaacactcttccctgttcttcatctggctaaccaatatttgtgctttctgtgtcagcataaacactgttttcctcagacaagatttcctgactcccagcctagccaggccacttcaaggtgtgtgctctccataaagtttacttcttctatatacatcaattcacataattatactttaatacttacttgtataattgttcgtgtgctatgccccccagttggctgtaagtcctataaagacagaggccacatccatcttgcacatccctctgttcctagcacctgccatgggtcctatcagctgacaagcactcaatatattgtatggataagtaaatatgattctaatttccaacatcctaaacttgtttacagtcccacggagcctgctcaggtagagcacatgcaatgcttcctatgcatgtgtttgcagagagaagagagagaagcccttctgcttctcccacgtgttaccattttgaccagactcagtgctgaaagcactgatgaaagggatggagacagtgagcctgtgaatgccgtgtgcagaacagcacttgcctttgtcccccatgaaagtaatgtgatgctcggtatccacaatcttttaatctggctgctgtagggtgagaatttgtggtccttttctgttaagatggaatcttgctgaaggtcagaatgtggttagagtcaaagagtggcatcactagcactgtgtataaaagaaagaatacaactcggatctttggttctctaccaacttgactcactttctccacagcaaggctcatattatcctttcctaatggagtttaggatgcaattgcagtcctcttcagacaagtctcctgtcccttttgctttattctgaaacaatggagtccaaaatctgtacttcttacatagtacagtgactagcttctaacattccagcatggctatctcaaggacttttgactaaatgctgccagttcatttggagtgatctctggcagggccaaattcagcataatgtagcttcctgttgtcttcctatattcctgtatgttattgtaaatatattgacgtaagctgacctattatacatgcttgttcccttctatggtgatagggactaggaaagacaatgcactgttcactctaatgtaagggatcacatataattcttatgatttgatgattctcttctggcactcaaacctgcttgtagcttttaggattcatggccactggtggcattaaacacttagggcctgtcatcacaaaaggacactttgtacacaattatctttccaaaggctagatcagcccatgtcaatgtcatgtttaatatttaaacaaaacacactttactgtcatttgtatctatttactcagtcaccatctgcaaaaccactgtgaataaaaatggaacttgtggtgcaagaaaaatatattgagaatcattgagttggacagacctagtgagaaggttgtgtctattcaaacacctgtcttccaccctcccaccatctgtgcaatcacttcacccttcagcctcactagtccccctaacaattaccctgtcaagaggagagtgcagctcaggtggatttaatgtgggtttaatatggcctgttgagtttaatgtttaatgttgattttctttaagtaaccatttctgttcttgctataaatctatgtctatatgtctatgcttaatttggatgatgaaggcaacttggatttaaggaaagagccagtttatatgttttatgaagagattatagatcaaataagcagacgatagaccttccaaagctataagtgaaaacagaaaaatgacgcgtaattcacaggttacagtgaagttaaaagagagggttaatattttaatgtgttgttaagaattc

SEQ ID NO: 383552 - DNA, 570 bp, Homo sapiens
aatcatgtgaagacggcatctaccacctcaaatcgcccagctcattgaacctgcgtgaggatccagcactgtccctggtgtgtacagctcagtgcaccgagatgaccaaccgcctgggtttgctttactgtcactgctaaaggcaggaaggcagctgccaaaccaggacaaggtggtcaccccacggtgaacatcagtcaccctccctagcccacacaggcaaacaaccgggggagactatggctcagggcttagaacccaaaggcctgaacaaatgaggaagtttctacaacaaagactttctttgacagagtaaccagtcataatttctgagcattccaggagcgctgtgcagaatcacaggtatttggcaactagtgggataaaacaaaggtgccattgaggatgtttacaaccaacccctctccggagataacctcaaggtctttcccttgcacatggcctttccatgactcatccacagcagctgcctccctccaccacacaaaggaccctgcaagttctgtttggtattcttgagaataaaaactccgtgggtcgttccctgga

SEQ ID NO: 383553 - DNA, 1480 bp, Homo sapiens
aatcatgtgaagacggcatctaccacctcaaatcgcccagctcattgaacctgcgtgaggatccagcactgtccctggtgtgtacagctcagtgcaccgagatgaccaaccgcctgggtttgctttactgtcactgctaaaggcaggaaggcagctgccaaaccaggacaaggtggtcaccccacggtgaacatcagtcaccctccctagcccacacaggcaaacaaccgggggagactatggctcagggcttagaacccaaaggcctgaacaaatgaggaagtttctacaacaaagactttctttgacagagtaaccagtcataatttctgagcattccaggagcgctgtgcagaatcacaggtatttggcaactagtgggataaaacaaaggtgccattgaggatgtttacaaccaacccctctccggagataacctcaaggtctttcccttgcacatggcctttccatgactcatccacagcagctgcctccctccaccacacaaaggaccctgcaagttctgtttggtattcttgagaataaaaactccgtgggtcgttccctggaattggttctcacccattttctttcctctgaccgtagccaggataggcatctaattctatagcttgtccgtggaatggaaaaacaatttggattttcacaacctgaaacctaatttctggtaggaaggtaccatctggtggatatttgtgaaactgctcacgtcctgtgtttgaaaatgagcatctgggggcagcgtgcctctccgaatgtcaataggaacgttgctccgagaggaggagagatccacactcaatgtggctgatccccttaactatgtgacactgtgtatgtgactatgtcataagcagcgtcatccctgtttacagttttctcagtttacaatgaatttaaatagctacccattgcctcttcctctccaagcgtactccttgctcctccgtgacaggcacattgatctatgagagttgtctcttgggaaatctagtcatatctcatgcgaacattttctaattggtgcacccacccctctgtgggcatgttcgcacagtgtcatgggccctttgtggagggttgtcccctttgttcaccacagcccctctctctgagactctgcaccccctataggaggtcgggggtgtctgccatgtttgtgggactagcccccaaacagcagggtgagcagggttgaccacttgctcaagctgggcagtcagattctcactctcttgagatctggaaccagtattcagaaaccacgaacaagtgcagctggatctgcggtggggtggaccccagcgcttaggggcatgctgctgctgccatgtgcacaaagcagcagccctgcctggcctgcagagtgagtaccagcccagagcagagacagctggagaggcccttctgcctatgccctgaggcagtccacatccctgggctgcattctggcccttga

SEQ ID NO: 383554 - DNA, 472 bp, Homo sapiens
  misc_feature (260)..(260): n is a, c, g, or t
catctgtagccccttgctgtacagtgtcatcatatccaataaggcttgcttttctctgattttaggggtgtatataataggcctggtttgtgcatcagttcatacaggctgtatgtttagggttcaattctgcaaatttgatttgattaaccattatttctgtgatcttcttcccctcctaaagctctcttgctctagtatctatgtcaacaaactacttattctatgtgttggtgcatttaacatccttgtccccagcntgaccatcctttgctcttacatctttattattgccagcatcctccacattcgctccactgagggcaggtccaaagccttcagcacttgtagctcccacatgttggcggttgtaatcttttttggatctgcagcattcatgtacttgcagccatcttcaatcagctccatggaccaggggaaagtatcctctgtgttttatactattattgtg

SEQ ID NO: 383555 - DNA, 903 bp, Homo sapiens
aatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggta

SEQ ID NO: 383556 - DNA, 1317 bp, Homo sapiens
aatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgtttt

SEQ ID NO: 383557 - DNA, 2189 bp, Homo sapiens
  misc_feature (1906)..(1906): n is a, c, g, or t
tccagatgttgtactgcttctcaaaggatgcttttctatttatttatttatttattcattcattcattcattcattcattcattcattcatttgacgaagtcttgctctgccccccaggctggagtgcaatggtgcgatttcagctcactgcagcctgtctcccaggttcaagcgattctcctgcctcagcctcctgagtagtggggattacaggcgcctgccagcacgcccagctaatttctgtatttttagtagagacgggttttcaccatgttggtcaggctggtcttgaactcctgacctcaggtgatccacttgcctcggtctcccaaagtgctgggattacaggtgtgagccaccatgcctggtcaggatgcttttatttctaatacctatccgaataaattaaaaggaccatgtttcctatgtttcacatctttgtaaactttttataaaattgtagtaaaatataatttaacctattgtgactttgtggaaaaagtgagtttgaatgtcagtgttattggcttttttgggtttttcacttgctaacaattgatctttaatccaaattaaatgctatttactttaagggtcttttaaatatttcattactaattttaagttaaaactgatcatgtacagtggctcatgcttgtaatcccagcattttgggaggctgaggcgggagtattgcttgagctcaggagttcgagaccagcctgggcaatgtggcgaaaccccgtctctattaaaaatacaaaaattagccgggtgcggtgacatgtgcctgtagtcccagccacttgagaagctgaagtgggagaatcgcttgaacccaggagacggaggttgcagtaagccgacgttatgccactgcattccagcctgggcatgacagatcgagaccctgtctcagaaaaacagaaaagaatcttgtttgtaatactttaaaatactgtaaatagtatataaatagcaagttttgtttttatttctaattactgaaagtaattgctattttatcttttctatagttttattagactcctttttagaattatgtgattaaaattgttacttattcaatattgaatatctgtgttcaatacaatattgaagccagcctctgcttgactaggagaaaaaaacatccttattcactgtcatcgagtttgtagctttgtggtaaatacagataaaaacagcagttacaatataatgattgtaatgttcttgtcttatttcactttatttcataatcttattctgtagaaacatagtgatttcattggaattattttcctttatgggttttttgaaccaaaattagcacacattggattataatggaattgtttctaggtttattttctccactagattagaaacaagaaagcccaggcctttttctacaactaaaaatactcagatttcattgaatgtttgggtaattgaatttgagtggttttgtttctttgttttattgatgaatttattattgagtaaggacacttcctttttaaaaattacttggtatcctacatagattactatattaaagcattatttggctgttctcaatcagtgttttctttgttcagtgtgccaagatcatactctttagaacattgcattatgaaaatgaagttttgacagtcagttgtggagtttttgttttgtgtgtgtgtgtgtttatttgttttttaccttcccagttcttcagccctcttcccaccaccacaatgaccccatcaagagagacaataaatgtacccataatgtttgtgtaggatcagaatttattccagtattcacagcttttgaagcaagctttaagattgcataaatccttagtaatcatggtttaagagaaacaatcccagctcctataatttttcttcnctccaatcagaaaggcaactggccatgaaatctcagctggaatatttaaaaggaaattcagatatggcttgctcgtttgttaacttattaccaaatgtattaaccaaaggaaagaatttaggccaaatctgacagggtcatatgacatatgcagggaaaagccaacaggttcctattaggctactcgaactcatcctactactactactcttttgcggggttaggggtaggttttttaaaatgttcttgtgtccatcagtcacaagaggaggtagttttcact

SEQ ID NO: 383558 - DNA, 414 bp, Homo sapiens
ccaatgttgtctacaactgataatagaatataaaaatagaataagaacttaaaggaaaaatagacaagtctacaataatagttgaagatttcaacactcatctttcagtaattaatggaagaaatagacagaaatcaataaggatatagaagactgtcagctaccttgacttcattgacatttacagaatgttccattcaacatcacagtatatgttcttttcaagtgcacatgaaacattcaccaagatagactgtgtttaggtttataaaacaggtctgaataaatttttaaaaatcaaaattatgcaaagtaatctagttatgacagaattaaactagaaatcagtaacaaatatatatctgtaatatcccctgaataattggaaattcaacaatatttatccaaataact

SEQ ID NO: 383559 - DNA, 489 bp, Homo sapiens
cactattagctgatatcacagtgtgtatcaccttaaaatgcttagggagggcagatagctgtgctctctacctttatctggagttattgagtctgatcccttcgggcgaggcctcattcccacttccatggctggtttgggtgcagacatcatccaactttggacagaggatacaggctggcttgagctggcagcttgtaaagattttcctttcttcatgggtattattgcttgtcttataatgttggtgatagatttttcaccttccaagctgcccaaacccagtcaatttccacgtgactatactggttttagtgatgataaagtcattgtttaagctacatttactcattgcagttttattctctgtgtgctgtgggttgagagcaaaattggagtctgccaaaatgaaaaagtgagtggttttgtgaggttttcaattttatgtacttccaaggaaatagcaaaaacaaaaaaaccaaaaaaaaa

SEQ ID NO: 383560 - DNA, 425 bp, Homo sapiens
gcatttcatggctcttcatcatcttaatatgaacttcatttccttagcctggaagagaaggcttcacgctccaagtctggctctttgtagacttgactcagctgtcaccttccctgggaagcacattcagtacactgcccctatcttgaagaggcgggaagcacccgctctggcttcccaaagctccctgtgcattcatctataatagtacttctgatattataattagttttttgtctccttgaacaaatgatgactttcagaacaggcatgaactatcttttttacctctgtattccaaagcctaatagtaatgcaaagcatatagtaagtaattgtaaaatatattaaataaatgcatactatttttaaaatatctgatgaactctgaggttcccatacacacaaataaacagaagtaaaat

SEQ ID NO: 383561 - DNA, 561 bp, Homo sapiens
tacgtgaggtgttttaacatggagaaagtaatttggagccacacaaacctgaggtagagtccaaattattggtctgtggaatgacgtaagctctctgggtcttagttttcttagctgtaaactggggataatagcatcctcttcatcagattgttttgagaattaaatggtgcaagcttaatgcctattatacagtgtctagcacatcagagctcagaagatgatgacaaagataacagtgacactattatcgatgaaaatttccacgccaagcacagtggctcacgcctgtaatcccagcactttaggaggctgaggtgggcgtgttgcttgagctcaagagttcgagaccagcctgggcaacatggcgaaaccttgtcttttagtagactaaaaatacaaaaattagctgggcatggtggcatgcacctgtagtcccaggtactggggaggctgaagtgggaggattgcttgaccctgggaggttgaggctcgcataatcagtgagccgtgattgcaccactgcaatccagcctgggtgacagagtgggattccatgtc

SEQ ID NO: 383562 - DNA, 307 bp, Homo sapiens
agattgtctgtactctttaatagttaaataccaactgtttggtattaactatttaatagttaaacgctaagccgaactaaaaacctttagtgtatgagtcatacttgtcatcttgaagctcttaccctaagtcgaggacacgttttcttgggggtgtctctcaagtaggtcgttagtcttgagttggctgcgttgctggaaagggattatccagtctcttcttggaggatatcagcttgatttcttgcatcctgggagctggttatttcactgtttagcataaagacttacacctcagctccctgtt

SEQ ID NO: 383563 - DNA, 453 bp, Homo sapiens
tgaggcaggagatcatttgaatcccgggaggaggaggttgcagtgagctgagatggcacccactgcattccagcctgggcgacagagcacgacaccgtctcaaaaaaaaaaaagaaaaaggcctctttatatatcagtgtcccttcatttttagtaaaattggatgccataatagaaagtgccttcatgttggcatagcttaaaagtatttttcatgttgctttcagagtaatatgtctctattctccttcccccattaaaacatttcaaaagcttcaagcagcacaaatgtgacaaagtagaacttcaaagccttcccaccagatacaatcactgtaaatagtggctttttataatacagctcatatgggcacagttgtacatctctccctgtcaaaacatacagccctttttattgattaattgcattttgttttgtggattccattatgt

SEQ ID NO: 383564 - DNA, 764 bp, Homo sapiens
  misc_feature (284)..(284): n is a, c, g, or t
gctcaaagtatcatttcctcttgggtatccgaagaggcttattatggaagatttgtgcagcagcgatatctcagttacaggcgggtgcctcacaccaatccaccagaatatgaattctcttggggtccccgaagcaactggaaatcagcaagatggaagtcctggggttcgtggccaaactgcataagaaggaaccgcagcactggccagtgcagtaccgtgagccctagcagacgaggccgacaggcagagcaaggcagactgaagccagtatgagggcaggncagtgctagggccggcatccacctctggtgagggttggtgaaaagttggccagtgggtccccgtgaggacgaactactgtcctgagtcataagtaatatgggtggggcgagggtcttatttctgtagaaatcgtgtgactttaaggatttagattttgtatcttatgttttgtaacatttaataattactgttaaaatgctgtttgtaaatgagattggtctactttttcctgtaggattttattgtagagttttgctggttttgtaaaatggatggaagaactttgtatttatactgtgattttgaacagattatgcaacattggaaggaaggctgtactttgatggtttgaaggaactcagcagtatgatgatctggttccaggggaaaaaaatagctggttggtgtctagccccccaacacttttgtctgttgtgtataaaagaagaaagactggcatgtaccttcatttgcttagc

SEQ ID NO: 383565 - DNA, 480 bp, Homo sapiens
ggcaagaggtcaaggatgctccctgcaggggatgacggccaagctgaaactttggttgcaggggaggcaacccgaggaggggcctgaggctgggcacgggcagggggcatccaagccatcctgcgtggatgaaaactgggtgtgtttctgcagtacgcagtgctctggggggagacctgaccaccggctgcatgcctgcagttgggtgtgatgtgcttacgtgccatgcaaacgtgggcacacagtcgtggcctcttgacaattgcacagacaaatccccagcaaggcagcgtggcacaggagccaacaggaaggaataaagaaggcatggatttcatggcacgcttgatccaacggggaaaggtgggattctgctaattttgcttgagtagaaatctaaggctgataattacctatccaggcttcagtccagaataagtgattaataaaagaattctgcagaaccaggccaggaatcct

SEQ ID NO: 383566 - DNA, 778 bp, Homo sapiens
  misc_feature (1)..(1): n is a, c, g, or t
ngggagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcgggacggagactcattctgtcgcccaggctggagtgcattggcgcgatctccgctcactgccaacctcagcctccggagttcaagcgattctcctgcctcggcctccggagtagctgggactacaagcgtgggccaccacgccccattaattttgtattttggtagagacagggtatcaccatgttggccagggtggtctcgaactcctgacctcaaatgattcccccacttcggcctcccaatgtgctgggattacaggtgtgagccatcgcaccgggcctaatattttattttaattttttaaaaatagagatggcctctcactgtgttggtaggctggtctcaaactcccggcctcaagcaatcctcccaccttaacctccaaaagtggggattaccacttccggcttaatattttaaactttctccagggtttatagaaaaatgtgattgacaaaaatttaataaatctttacctatggtg

SEQ ID NO: 383567 - DNA, 244 bp, Homo sapiens
ctcgtgcctttcaagtataaataattttaaagcaatagcttgtttttctttgttttctttttcaatgaagtgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaata

SEQ ID NO: 383568 - DNA, 1322 bp, Homo sapiens
  misc_feature (1)..(1): n is a, c, g, or t
ngggagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaacttgttaataa

SEQ ID NO: 383569 - DNA, 1072 bp, Homo sapiens
ggatttgctgaatgccaatgttgacagtggtttatttaatgttttctattattgacgtaatgatttttttctatttgcttacagatagttcactgtttaattggtgagtttttgcttcaattttatacttttattataaattgcctttagggcaatagttcactatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaacttgttaataa

SEQ ID NO: 383570 - DNA, 884 bp, Homo sapiens
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaata

SEQ ID NO: 383571 - DNA, 596 bp, Homo sapiens
acagatagttcactgtttaattggtgagtttttgcttcaattttatacttttattataaattgcctttagggcaatagttcactatagttcactgtttaattggaattgtacctacttctgtgattgtgactggggtccaagtgagttcaagaatctttatggtgtggctcattactcacagtataaaaccagtaagtgacacaaacatgttgtctacttgagcctgcaggaaagctttccattcataggaatctaaaatattaacatttgtatatttcaggaggtggaagtgttggacaaaaaggagttgggtttgagttttagatgttgtgcattgacttagtgccttagcagaatgactttgatacacaaacaaacccaaatattggcatcttagatccgtaatatattctcctttgatattttccagtttttgaaatcagtattcaggttctgtcaaataacctgcagaaaatgttcttttctatagaagtttcttttcaatccaagttgtcctctttgattatgtaatcgaagttgtcagtatacaatttattatttctggccagccgcagtggcccacacctgtaatccc

SEQ ID NO: 383572 - DNA, 1006 bp, Homo sapiens
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaata

SEQ ID NO: 383573 - DNA, 997 bp, Homo sapiens
  misc_feature (1)..(1): n is a, c, g, or t
ngggagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaata

SEQ ID NO: 383574 - DNA, 1346 bp, Homo sapiens
  misc_feature (1)..(1): n is a, c, g, or t
ngggagagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaagcagagcggccgttcattctatctaatagtactatcatccacctccgttga

SEQ ID NO: 383575 - DNA, 871 bp, Homo sapiens
tatacacagcccagccagcacccaggtccttccatccttctgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcaagcggaggcgcctggggttcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccaggtggcgatatcttgcagtttagtttctccttgtcctgtgcatgcttattttgtgtgctaacgccagagaattaaaattcgtgtttcagccccacgatgccagaatgctgttataggaggtataactggtataactaataattatacaagttatgatttgtattctaaaagcttaatgatgagagaggaatcgtattaataaatattttgagtgaaatc

SEQ ID NO: 383576 - DNA, 1112 bp, Homo sapiens
gggaaccccttagtcggccgggcattttacggagcctgcactttcaaggacagccacagcgtgtacgaagtgaggaattcctttccaccaagagcgctcattttagcgacaatacagaattccccttcctttgcctaagggagaaaggaaaggaaacattaccaggttcattcccagtgtttccctggagtaatgctagaatttacttttgtcataatgcaaaattaaaaaaaaaaaaaatacaacgaagcgatacgttgggcggatgctacgtgacagatttttccaaattttgttgcggggagagggagggaggagaattgaaaacggctcacaacaggaatgaaatgtacatttctgcagtggatttaaaaagtactgcttggttagttggaagaaaaataatttcattggaaaacagtaacagtgcattgacgtttttcttctacaactttaggtaaagaactataggtggtctcagaagataactaaatcttttacctttttgctctttcaaaagcctccccaaaatatgcataaagatgggattagaatctcaacaattctcttaaaattaccctttgcgagcaatatatttccaaaatcacatttgtaaaaatgcagtacgtctaaaagaattatttctattttaaatgaccatttacattttaaaaaatagaatgtatcttgctatggtttggaaccaaatagctgcagtttgtattgatgtcacagggatggaaaacaattttgatgaagagtaacatgtatgtacaaatcacctgccatacacactatccagttttgaacattggaatttaattaaacatttttttcttctgaagtggctttgagattacttcacttttcaaatctaattactatgagaggggggaggagagcccttagttcttccattacatccttcctccatctgaatgtttctgtgggatgctatggttaatgtgtgatgatttcactttcacttcataaacccattgtgtacctcacaagtagcaagctgaggacattttaaaattaatctttttaaaatttaggaatgcttagtaaacattttactctcataaaaatcttgcattaccactgctata

SEQ ID NO: 383577 - DNA, 900 bp, Homo sapiens
aaaactttggctaggtacgaggctggtgggatgactctgacccagggtctcatctcttttgtcaggatccatgaaactgtgactggcagcatgcaaacaggataaaatctcagcacagttcctgacggtgtccttactaccttctcagactcatcaccattacctaatattttaaggtccagttgcagagaacagagttaattctaattagtttaagcaagagaagactttccaaatgacatactaatctgaacttagaattgttgagaactgagctttgaggaagcactcccaatgccacattacagaactgggtcaaccaggagagctgcttcctcttctaagttcaggaaaccactcactcccaagtataccaatattgagagggtccagatagtgccataatcaggaatccacactaccactgctggttctctgcaacacttgtcaggcttgctacaatctacctccagttagatgttttgtaccattcctcttgccacttaagaacctcatgtctgcacactgcctcagaaaaggcacttccatgaccctgcttgctggcatttagcacagcctgcatctcacgtctgccttctctaggtgcatctacgtggccaaaattaaatcacatccagacccctagctgcaagaaagtctgagaaatatagcctctagctttctctctaatttgttacaggaggacacactaggagtgtggaatgaaggttcagcattgagttagcccatgcacccacacctgtaagcttctctgagatcaggaactccagctttgggcaacaaagaaaacatagccactgtcattattcacaggttcactcatgacctgtcatttggggtttcagcttaaattaacccgttcacccttcatttaaagta

SEQ ID NO: 383578 - DNA, 920 bp, Homo sapiens
gatggaacatgaaacttatgctgcttttgctgtgctgtgaatgaagtcatctgactctgacccagggtctcatctcttttgtcaggatccatgaaactgtgactggcagcatgcaaacaggataaaatctcagcacagttcctgacggtgtccttactaccttctcagactcatcaccattacctaatattttaaggtccagttgcagagaacagagttaattctaattagtttaagcaagagaagactttccaaatgacatactaatctgaacttagaattgttgagaactgagctttgaggaagcactcccaatgccacattacagaactgggtcaaccaggagagctgcttcctcttctaagttcaggaaaccactcactcccaagtataccaatattgagagggtccagatagtgccataatcaggaatccacactaccactgctggttctctgcaacacttgtcaggcttgctacaatctacctccagttagatgttttgtaccattcctcttgccacttaagaacctcatgtctgcacactgcctcagaaaaggcacttccatgaccctgcttgctggcatttagcacagcctgcatctcacgtctgccttctctaggtgcatctacgtggccaaaattaaatcacatccagacccctagctgcaagaaagtctgagaaatatagcctctagctttctctctaatttgttacaggaggacacactaggagtgtggaatgaaggttcagcattgagttagcccatgcacccacacctgtaagcttctctgagatcaggaactccagctttgggcaacaaagaaaacatagccactgtcattattcacaggttcactcatgacctgtcatttggggtttcagcttaaattaacccgttcacccttcatttaaagta

SEQ ID NO: 383579 - DNA, 352 bp, Homo sapiens
aaactagaaactactgaaagcctctaggtagctgggtcaggagtaagcctactgagctactgctacccagaaaaacccctcacaccaccccatgtgtcctacaataaatgtttgctaaaaaagtgtgtttgttagtgcagatgggacccccgtatgcatggattcactatctctgtgcttcaaaaagctcttgttagtcctttccagtggccaacactcagtgcagcatgtggagcataatagatatgtaataaatatctgttgaatgaatagtgaatctacagatggtctgttgggaaaactgagccatactgttcttatagtacctaccattcttcacctgtattggcaa

SEQ ID NO: 383580 - DNA, 275 bp, Homo sapiens
  misc_feature (240)..(240): n is a, c, g, or t
tgtcagacctccacgaagtggtctccctgaaggagcggatggcgaggtaccaggcagctgtttccaggggtgactgccgcagcttctctgctaatatgatggaagaatcagaaatgtgcgcagtgcctggtggtttggccaaggtgaagaaacaatttgaggacgaaattacttcttcccgtaatacctttgctcaataccaatatcaacatcagaacagatctgagcaggaggcaattntatagcagcccagggtttgcacttcaaagaaggca

SEQ ID NO: 383581 - DNA, 322 bp, Homo sapiens
agaggcttggagttcaaagtgtgtgtatacatatttttttctattccttaataaattcaaaccctaaatgctaaccatattggaacagtggactggccttcactcttcagtcttctcatgacaatgtggtgctctataaatcttgttttgcataaggacagggaaaagaagaaatcatcaactcagcagagatgtgaacttgagggccaataattgcttttacattattttccttaatgtcttgttccctactctgtcctcagatcatagcagagaacaaacaaggaggaggaagaacaggaggaggagggggaaaagagga

SEQ ID NO: 383582 - DNA, 389 bp, Homo sapiens
gaccacaggcatgcagcactatgcctggccaatttttgtattttgggtagagacagggtttcgccatgttgcccaggctggtctcgaacgcctgcctaagcctcccaaagtgctgggattacaggcgtgaaccaccccgcccagccccatgttgaactcttaactgccaagcagagaaaaaaaaatccttaccatactaagacaactttaatgatactttcacctttgggcaaagggaaagcattcttgaatatatcttaagaaccaagtcctcaaatactgatgaagattttcgacctcattcctaccaacggctgtgggttatgtgacgcatgcaaaaccaaagcataagaaaaactcaggcccaaggtagaacacatcagctacag

SEQ ID NO: 383583 - DNA, 429 bp, Homo sapiens
tattctcctgcctcagcctcctgagtagctaggattacaggggcctgccactgcgcctggctaagttttgtagttttagtagagacgggattttatcatgttggccaggctggtcttgaactcctgacctcatgatccgcctgcctaggcctgccaaagtgctgggcgtacaggcgtgagccacggcacctggcctttgtatgtttttgtaatacatgttataaaacgtatgactcaagtccttgacactttgaagagtaactggttgggtgttttgaagaatgtcccttaatttaggtttgtctaagggtttctcatgattagaatgagattatgaatttggattatgagattagaatgggaatatgcattttagtaagaatactgcagtaaatacagtaatgctggttacttaattagtaaaggttt

SEQ ID NO: 383584 - DNA, 513 bp, Homo sapiens
tcattggcaggaaacatgtcagttgcttgtttttacaaactgaaggaaatgaatgggatttgttggtttctagaatctaccttcattctctattgtcttgcaaatagttggctcagaacacttcgtttcgaaaggggctttggagtggtacaattcattctctgcaaacctgtggcatttaggtttatttctttctgattttggaattaggaaaattgatcgtggtacaaccatgtgcaacttattttcctaatacaaatgaacaagatgttcaatacaattccaaatcattttaagttgtcagctagttactcacacactcactgaagctgctgtttttggatggctatgccaaatttctaataattattccagaataccaaccaaatgccagtgtcgattttggattagtgtagagaggtaaagagaaagaggcagcttcattcttctcattgcttataacaaaaggtccataaagaatacacgttaggtatataccaaccttgctgatag

SEQ ID NO: 383585 - DNA, 461 bp, Homo sapiens
ggtgcccacctggaggagggcaggtagggaggcagctactctgcttcccagatagtggctcctgagcctgtggacctccctctggcctccagaggctagggttgcctggaaacacagctggacacaggcctcccttggcggtggccacacccaaggcaggaagacaaaggccacccatcaacagagaaatccaggttagcaaggagcccagcggttccctggcaagtggggctgaagtagggcagcgaccacgctgagtggctttccctcttccacactcacagggaaaggaatggaccccagccctgtgcaggccgggccctcatcctgggttgctgcctttccttgcaggagaagtgagcattcctgtttcacagctgggcaaactgaggtcaggggaggtcactggcgggggtcacacagccagtaagagatgaagcaggaatggagcccaggactgt

SEQ ID NO: 383586 - DNA, 469 bp, Homo sapiens
gatccctcatatgtgcagttcacaataggattcacgcttctatgagaatctaatgctgctgctgatctcacaggaggtagagctcaggtagtagtgcccgcttgtctcccgctcacctcctgctgtgtggctcagttcctaacaggccactggtaccggtctgcggcccagaggttggggacccctgccttagaagcctttgtagggacaaatatgatatggacaaatagcctatatgatagggtgattatgtcctccactctaatttcaccactattttaatttgcttgacatgtaggagttctgtctaatatttcctttgcgaaaggtttatagtgccaaaagaaaaagaaattggaaaccactgaaatgggaaaggggaaaggaaacacacccatgtggaatgctgacgctgtggtcagttctcaggtggaagttcttagaaggaagtcgggatactcatgaaaac

SEQ ID NO: 383587 - DNA, 458 bp, Homo sapiens
atactaaagcaaatgtggtaaaatattaacactggggaatcttgtaaagaatacaaagtaattatttgtaccattctctcgtctcttttatcggtctgaaattatgtttttcaaaagaatccaagtctaattatagaatcatacctgttttactgaattacattttttctcatgctaaagaatattcccaacaactgacaattttgatatacccctaacatggaatacaaatgacgcactaaataaatgaagttcaaataatcaattaaaggctatgtggactacaggatcattccaccctgtttcatatgagccaaaacagatttattagctgcaagctcaaataaagtgatctcaaatgagagttatgtcagtaaaaacactgcctcttaacaggtcagcaatgactttactcacttatattttacaaaatattttgaggatttaaaagattaaat

SEQ ID NO: 383588 - DNA, 563 bp, Homo sapiens
caagcaggtaattgccaagtacttttaccgtggttgctagtctctcgtgttttggggtatgggtgtgatagtgggaagcacaactatttgaatctcacatttagtagggttaatcagttactgattctggcagttataatagttcattatgcttgggtagaagacatgctactaagacactgagttcacctaatatacaacttcatttattatttaaaagtaactggtgcttcaaatattttaagttttttattttttacaacttattcagaaacatagtacatgacagtagacttttaaaaattgcttcttccttttggggacatgatagtactgatcccctgataggttgtctaatctgagtggtttttagtaagaatgattccatctgcacaccacccgaatcctatctgtaactaaaaggggacaattgtcaggttctctctctcctgtcagttcccaccttgtgtaccattatattactgaagggttgatactacagtttatctgttcatacatctgtctctcctactggattaggtgaccatcagttattcatcaat

SEQ ID NO: 383589 - DNA, 4452 bp, Homo sapiens
cccggaacccgcggtcgccaccgcggcggcggccccaggctggaggcgtccgggcgcctctttcctccagcctctgggactgcgctgctcgcagtctcctcgccctgcctgggcttgagaaacctagtgcataccccaaagagggtttttgtgtatgtgtgtgtttttaaagggtggctatgatgactgggccttggagatgtgagactgggaggtaaaatgcacacttgctgccccccagtaactttggaacaggaccttcacagaaaaatgcatagctggatgctgcagactctagcgtttgctgtaacatctctcgtcctttcgtgtgcagaaaccatcgattattatggggaaatctgtgacaatgcatgtccttgtgaggaaaaggacggcattttaactgtgagctgtgaaaaccgggggatcatcagtctctctgaaattagccctccccgtttcccaatctaccacctcttgttgtccggaaaccttttgaaccgtctctatcccaatgagtttgtcaattacactggggcttcaattttgcatctaggtagcaatgttatccaggacattgagaccggggctttccatgggctacggggtttgaggagattgcatctaaacaataataaactggaacttctgcgagatgataccttccttggcttggagaacctggagtacctacaggtcgattacaactacatcagcgtcattgaacccaatgcttttgggaaactgcatttgttgcaggtgcttatcctcaatgacaatcttttgtccagtttacccaacaatcttttccgttttgtgcccttaacgcacttggacctccgggggaaccggctgaaacttctgccctacgtggggctcttgcagcacatggataaagttgtggagctacagctggaggaaaacccttggaattgttcttgtgagctgatctctctaaaggattggttggacagcatctcctattcagccctggtgggggatgtagtttgtgagacccccttccgcttacacggaagggacttggacgaggtatccaagcaggaactttgcccaaggagacttatttctgactacgagatgaggccgcagacgcctttgagcaccacggggtatttacacaccaccccggcgtcagtgaattctgtggccacttcttcctctgctgtttacaaaccccctttgaagccccctaaggggactcgccaacccaacaagcccagggtgcgccccacctctcggcagccctctaaggacttgggctacagcaactatggccccagcatcgcctatcagaccaaatccccggtgcctttggagtgtcccaccgcgtgctcttgcaacctgcagatctctgatctgggcctcaacgtaaactgccaggagcgaaagatcgagagcatcgctgaactgcagcccaagccctacaatcccaagaaaatgtatctgacagagaactacatcgctgtcgtgcgcaggacagacttcctggaggccacggggctggacctcctgcacctggggaataaccgcatctcgatgatccaggaccgcgctttcggggatctcaccaacctgaggcgcctctacctgaatggcaacaggatcgagaggctgagcccggagttattctatggcctgcagagcctgcagtatctcttcctccagtacaatctcatccgcgagattcagtctggaacttttgacccggtcccaaacctccagctgctattcttgaataacaacctcctgcaggccatgccctcaggcgtcttctctggcttgaccctcctcaggctaaacctgaggagtaaccacttcacctccttgccagtgagtggagttttggaccagctgaagtcactcatccaaatcgacctgcatgacaatccttgggattgtacctgtgacattgtgggcatgaagctgtgggtggagcagctcaaagtgggcgtcctagtggacgaggtgatctgtaaggcgcccaaaaaattcgctgagaccgacatgcgctccattaagtcggagctgctgtgccctgactattcagatgtagtagtttccacgcccacaccctcctctatccaggtccctgcgaggaccagcgccgtgactcctgcggtccggttgaatagcaccggggcccccgcgagcttgggcgcaggcggaggggcgtcgtcggtgcccttgtctgtgttaattctcagcctcctgctggttttcatcatgtccgtcttcgtggccgccgggctcttcgtgctggtcatgaagcgcaggaagaagaaccagagcgaccacaccagcaccaacaactccgacgtgagctcctttaacatgcagtacagcgtgtacggcggcggcggcggcacgggcggccacccacacgcgcacgtgcatcaccgcgggcccgcgctgcccaaggtgaagacgcccgcgggccacgtgtatgaatacatcccccacccactgggccacatgtgcaaaaaccccatctaccgctcccgagagggcaactccgtagaggattacaaagacctgcacgagctcaaggtcacctacagcagcaaccaccacctgcagcagcagcagcagccgccgccgccaccgcagcagccacagcagcagcccccgccgcagctgcagctgcagcccggggaggaggagaggcgggaaagccaccacttgcggagccccgcctacagcgtcagcaccatcgagccccgggaggacctgctgtcgccggtgcaggacgccgaccgcttttacaggggcattttagaaccagacaaacactgctccaccacccccgccggcaatagcctcccggaatatcccaaattcccgtgcagccccgctgcttacactttctcccccaactatgacctgagacgcccccatcagtatttgcacccgggggcaggggacagcaggctacgggaaccggtgctctacagccccccgagtgctgtctttgtagaacccaaccggaacgaatatctggagttaaaagcaaaactaaacgttgagccggactacctcgaagtgctggaaaaacagaccacgtttagccagttctaaaagcaaagaaactctcttggagcttttgcatttaaaacaaacaagcaagcagacacacacagtgaacacatttgattaattgtgttgtttcaacgtttagggtgaagtgccttggcacgggatttctcagcttcggtggaagatacgaaaagggtgtgcaatttcctttaaaatttacacgtgggaaacatttgtgtaaactgggcacatcactttctcttcttgcgtgtggggcaggtgtggagaagggctttaaggaggccaatttgctgcgcgggtgacctgtgaaaggtcacagtcatttttgtagtggttggaagtgctaagaatggtggatgatggcagagcatagattctactcttcctcttttgcttcctccccctcccccgcccctgccccacctctctttctccccttttaagccatgggtgggtctaactggcttttgtggagaaattagcacaccccaactttaataggaaatttgttctctttttccgcccctctccttctctcctcccctcccctcccttctcattccttttctttgtttttaaaggatgtgtttgtatgcattctggacatttgaattaaaaaaaaagtattgtgatcctgtaaaggatcaccatagatgtggacaaatcattaaaattacagagctatatgatccataattgattagtcaaaataacttattgatgaaatatacaaatattttattgtagcacctatttttatatgcacatttagcattcctctttccttcactatttagcctatgattttgcagaggtgtcacactgtattaggatctgcatttctaaaactgacgtggtatcaggaaggcattttcaatcattcaaaatgtggagaatttaatggctaaatctttaaaagccaatgcaacccacccaattgaatctgcattttcttttaagaaaacagagctgattgtatcccaatgtattttaaaaaatagggcaattgattgggccattccgagagaattgtttgcaagttttgggttttattagaaaatatttgaaagtatttttattaatgaaccaaaatgacatgttcatttgactactattgtagccgattttcgattgtttaaccaaacccagttgcatttgtacagatccacgtgtactggcacctcagaagaccaaatcatggactgtacaagtctctatacaatgtctttatccctgtgggcagcaagcaatgatgataatgacaaacaggatatctgtaagatggggctactgttgttacagtctcatatgtatcccagcacatgtaattttttaaatagtttctgaataaacacttgataactatgtcaaatatga

SEQ ID NO: 383590 - DNA, 3492 bp, Homo sapiens
tgtgccgcaataaaatgtgtgaacacgtgtttctgtcgtgtgtgtcatgcacatctgtgtgttgcatagcataagccaaatgaaaatcatttgttcatgggattcatatgaggaacaaaattaaatttgaatacagtcagataactgccacgcagggcatttggggaaccatccccgaatgccctgatgtgatttccctcagaaaatccttgttattagaggagaaggtctgggcaggggcagcagcatctcagacatcaagtcaactttatcatctactacatcagcactgaagtccaggggcattgaggcactaactaggttccattttctttggtttggttacttattttttctttttgggttctcggtgtgcagaggctgtagagagagcctcagggcggtgaccgctgcaggaattcggccctccagctcccctcccagttacccaggagccgatttggagcccaggccttcccagctgagtgtctgtcagcttcattctctctcagctgtgcagtggaagagcaacaacagacaggtgaccttcttgggttgtgcttcacaatggactgggaaaaacatctttgaaatcaggaaatcaggccgggcgcagtggctcatgcctgtaagcccagcactttgggaggcggaggcgggtggatccattgaggtcaggagctcaagaccagcctggtcaacatggtgaaaccccgtctctactaaaaatacaaaaaaaaaattagctgggcgtgttggcgggagcctgtagtcccagctacacgggaggctaaggtgggagaattgcttgaacccgggaggcggaggttgcagtgagctgagattgcaccattgcactccagcctgggcgacagagcaagactctctcaaaaaaaaaaaaaaaagaaagaaagaaatcagaaaatcgaccacagtggtagccacctggcctaatgctgtgtttttgtacctgacaggggtcactcattttaggcacaactccttcattctttgtgaaattagtgagtttccttctacccgtcaccagattcaatatgttctattaatacaccgataaccacaggggaagggcacttgtcgctctcccacctggttaccacagtctccatgggtcttttgccgtgaccacaaataaaggaaacactcatcactagtatctaagtcgggctttacagtaactatgcaccttctgtgtgcttcacctcactctctacttcaaacagcccatggagggaggtattattatactccttatgttgacagtgaagaatctgaggcccagagaggttggggacttgagtaaagtcacacagccctgagaggcaggaccagggttccattcctgctctatccagttccaagcccttgtgttttccattatgtttagtgcctctttgctaacagcaacatctgcaagatttgtgttggttttgatggagaactctagctcatccacatgctagtgcccaagtggtggaggggccacctcagcaggtgggttctgaatgcagccaaggctgtccccgcaatgggtgagactcgctccaactgcccgccctcagagcaggtgcctaagtcctccctggcactggcaggccttacctcacattgctaaattaaagcaatgcaattcctcttgggtaagaggaattcctccttctttactaactgatccccagcaaggaaataaaatgttaggctttaaaaatccctactttgtcatatcagactatattctaaaactatatttgagcgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaa

SEQ ID NO: 383591 - DNA, 2484 bp, Homo sapiens
agctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagatgaggcgtgcagtcaatccgaatcactcgctgagatgttgccccttccagggtcactcgtcgtgtagacgctgcctttgtgcagctgagggaacagcccttggcccctgccacacaatacgtatttatattcacatgtgcctgttgtgggagcagggccagcagatcaccatgatgaggggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctcc

SEQ ID NO: 383592 - DNA, 2669 bp, Homo sapiens
agctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctccagggtactttctaagataagccttaaacagaaacccctaagaaaggttctctgaaaattatttggtgggttaaatgcctctgatccacagagtttcatatttgaagtctccggctttgggcctggcaggctggcacatccatatttgtatggaaaaaaaaaaaaaagaccctacgctaccacttcaaaaagtgacatgaagtgtagtatcctggcccttcattgtcattctctcatgatttttgttttgttttcaacaaaaattggttggtcattaaatatatcatatgttaggcacagtgacctggttattttcacatgttacttcattttcttatcaaattaaatgtttgtgacatagtatta

SEQ ID NO: 383593 - DNA, 2304 bp, Homo sapiens
agctagactgagcaagggaagtgacaggaaatggagctggggagacaaaaatgtggataacaacaaaagaatttcaacaggtaaaaaaatgagtcaaacatctctcaaacagaaaaagaatgagcctggaatgaggtcctcaaaagagagtctagaagcagaaaaaagaaaggaatctgacaaaacaggagttcgtctgagcaatcagggatcacaagaatcatcactgcggaagacagactctcgagggtaccttgtgcgcagtcaatggtctagaatatcccggagcccatccaccaaggctccatccatagatgagcctagaagcaggaacaccagtgctaagctccccagcagctccacgagctcccggactccatccacctccccaagcctgcatgactcctcaccgccgccgctgtccgggcagccctcgctccagccacccgcgtcgccccagctgccccggtcgctggactcgcggcctcccacgcccccagagcccgatcctggctcccggcgcagcaccaaaatgcaagagaatccggaggcctgggcccaaggcatcgtgcgggaaatccgccagacccgggactcgcagccgctggaatattcgcgcacgtcccccaccgagtggaagtcctccagccagcgcagggggatctaccccgcctccacccagctggaccgcaactctctgtccgagcagcagcagcagcagcgggaggacgaggacgactacgaggctgcctactgggcatccatgaggtcgttctacgagaagaacccgagctgctcgcgcccctggccgcccaaacccaagaacgccatcaccattgctctctcatcctgcgcgctcttcaacatggtggacggcaggaaaatctacgagcaagagggtctggaaaagtacatggagtatcagctcaccaatgagaacgtcatcctgaccccgggcccggcgttccgcttcgtcaaggcactacagtatgtcaatgctagactccgtgatctatatcctgatgaacaggacttatttgatattgtactgatgactaataaccatgcccaagtgggagtgcggcttataaacagcgtcaatcactacggcttactgattgaccgcttctgtctgaccgggggaaaagaccccattggctatttgaaggcatatcttaccaacttgtatattgctgcagattctgaaaaagtgcaagaggcaatacaagaaggtattgcctctgcgacaatgtttgatggagccaaagacatggcttactgtgacactcagctccgtgtagcctttgatggggatgctgtcctcttctctgatgagtctgaacattttaccaaggagcatgggctcgacaaattcttccagtatgatacattatgtgaaagtaagcctcttgctcagggtcccctaaaaggctttctggaagatttaggcagactgcaaaagaagttctatgccaaaaatgaacggttactttgtcctatcaggacctacctggttacagctaggagtgcagccagttcaggcgcccgtgtgctgaagacccttcgacgctggggtctagagatagacgaagctcttttccttgctggagcccccaaaagtcccatcttggtgaagatccggccccacatcttctttgatgaccacatgttccacattgaaggggcacagaggttaggttccatcgcagcttatggctttaataaaaaattcagtagttaggggcagggaggagaaataaagtggtgatagtctggtgttacagaagccacttcttttggctctctaggataattagataggtatttcagaaaattggaccttaaaactttgcttctttggaaaggttttctcctgattttttggaaaaccttttgaaccctcaagttaccatcaaactacttctctttgaactaccaatactgttgaatgccattacacctatctctgtgtaagtcataatgatgactctttaggataagtttagaacttgaatatttgcatgcttaaggcactgttttagaagcttacttagttttataaacactgctcatttttggatgtttgtagataacaatgaattgttacccatcagcattgtagaatagtgtcttcaaaggtagaaggagtatggttaagcacactcttgaaaactggagctttgtattctgtgactgctatggctagctttgtaaccaaagcaaaatgagaatttcactctacctgcatgagtataacaattttgatactgctcatttagaaataaatcatctggttgttcctcc

SEQ ID NO: 383594 - DNA, 636 bp, Homo sapiens
gacagagtgagactccatctaaaaaaaaaaaaaaaaaaaaagcctgtcttttagttactgggtttggtattccctgattttttgaattctttgaactctaccttgaggtgtcaagtataatcctgtttttgccattattgttacaaagagcatgctgtagagaagacacattagatttccaatgacgaaagcagagatacaggaaccgagcaaagataaggatgggtgtgttaccagcaccagaaggaatggaaggataaagtacagggtttgatagttaggatggcttcagtatccatgaactatgaaagtctaccaaaaaaatagtgacagtcaaacacaggagcaaatctgattctagggcacagagtaattattcactggcctattttcattttgttggggacagtttttactataggaccatttaataatatcactccttctcaaaccattgtgaaaaccgaaagtgctcatatttatttgttagtgcattaacggaagataatgccccagtggggaattgatgtttggggagatagaatttgatggttgtatacaaaatgaataagagggatcagatttaatagggatctgctctgctttcttttttttttaatattaatacctttaata

SEQ ID NO: 383595 - DNA, 525 bp, Homo sapiens
acagagcgagtcgacgtcacaaaaaaagtcttaattttaaaaaaagaaaagaaggaacaaccccgggctgcagatcagaccgcccccctggctccctcgcaatgcgggagtgctccctccaggtcaccgtgtcccctcccgcggcaccggtaggggagctggggagatcactggcagctccaaatggtttcgtaactggattgtttgtagcggatgcacccgcgggaaggcgcaggtcccaagtgattcggcagagttcagtccaagcagaacatcctgaacccccagctcggggcagccttcatcatcttcccttgctttggtgcagcgtttcagctcaaaatcggtttggtgtggagtttaaactcaaatccctactgggccaaagaaaattcgcacccgatggctgagtgcaagtggttcacacctgtaatcccagcactttgggagaccgaggcgggcggatcgcctaggcaacacagtgaggctcctctctacaagaaaagagagaaaaaaaagtattta

SEQ ID NO: 383596 - DNA, 886 bp, Homo sapiens
gcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccaggatccacttaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaac

SEQ ID NO: 383597 - DNA, 824 bp, Homo sapiens
gcatgtgctggcagttgctctttggagcacccacttcacttctcccatgtagttcctgagtgcaggactctcctgaagaaggggcgtctaaaagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaac

SEQ ID NO: 383598 - DNA, 1041 bp, Homo sapiens
gcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccaggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaac

SEQ ID NO: 383599 - DNA, 1449 bp, Homo sapiens
gcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccaggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctaggtatctgatgtcctgcccttggcagttttcaactccagatgtaggtctgactcctattaggctaccatttctttgtgggaagacaggtatgaaattgcagcattcctaattctcttaatgtgaattgtcagagccccttcagaccggtggctggggccaggcatgagaggcaggtggtaagggcaagaggagcagcccctgtgcacttggggaggctggaagggttggcgaaaggagctgaaaacaccctagattccccaaatggcatgaagagatcccagccctgaggcacctcccactcaagccggagatgagcttttcccaaaatccaactctatgaggctctcactcaatgtgggctcctgatgctgaggggacatcctgacacccctgtgttctcttctgcagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaac

SEQ ID NO: 383600 - DNA, 1127 bp, Homo sapiens
gcatgtgctggcagttgctctttggagcacccacttcacttctcccatgtagttcctgagtgcaggactctcctgaagaaggggcgtctaaaaggccagcccatgcatcttgttcagaccaggctgctccatctccgctaagcccaggatccacttgtgtgtctttctgggataattgtctttagtggcagcctgggcctcggggaaggaagggcatgaggaatggccccggctgggatgtcaggggcccaggacaactcctgtctctaccaggaaattgccccctcttttcagaggctgccttgtcctaggtatctgatgtcctgcccttggcagttttcaactccagatgtaggtctgactcctattaggctaccatttctttgtgggaagacagaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccccactgattcagaagataaacaggagaagtgtcctgtttcacccatattgctggtcctgatttttcaatagtgtccctaccctgaagctcttccattggtcatcatggagttagctaacagcccagggaactggtctcttttcccttttcccttaccacctggaactcacctggaaagggcaatcagctggctctatatcagacgccaccacctggtctttgaagtttctgtcctaccagtgccacagctccctctcccacttctgaactacctccaagagagaccatcctcagcagcctagtatgttatgctagtcctggaatggtgtattctggatgtctactcaaggccaaaccccagtattgcctttcgtttccctattcaaggccaaggctagattctcttcattgtctccatttctctttctccagagctcctatagggcaagacactgtttctcatatatttctggatccttggagcttagctcggagcttggcatacatgcccagcatgaacttttctgaataaaataatttcaaatgctgtatacaggaaac

SEQ ID NO: 383601 - DNA, 336 bp, Homo sapiens
tggaataaggttaagtaaaggttaagtaaaaatgtggaatataatatcttacacaaacattacaatctcatgtaagtataaaaatatgtataaaaataaaaatacatgaatgtgctaatagtaactgtctctgcatggtggcattggtgggaggagtattttcttctcattttctgtattttccgtattttaaaccatttaaatgtaaagagtctatgaatgggattatgtggaggagaaagaagcaaagactgatctggccaaacatgcaggagtccattacagtttggggcagcagctgtgttggcagaagtgagtctgggtgggcccggcagg

SEQ ID NO: 383602 - DNA, 506 bp, Homo sapiens
ggtgacggccgtcgtgagggaacacgggacgcccacgtgccctccaccacctcctcccacggcaaccctcgcagagtagccaggaccacattcggatccggactctgaaatgacagtcccacaaccaacagcatcgatgtggtcttcttaatgatcagaaacacacaggggattaatttactcttattctgcaaaataaacaagctctcaaattctttaaaggtgaatcccccccaaccgtcctccctccccagttacttcctccctaggacaccagtggaacatcccatgctctcccccttccatgttgataccgaataaaacacactgcatcagaagacccacgcatacgagtccaggggctgctacaaagcacggcgacgtctccgcggcgagctggccactccatggtcccggcgcagacactggggcaggcgccggctctgtcgtcgaggcgctcacaggcaggcacacgtgagctcctggaggacagggagagcggccgc

SEQ ID NO: 383603 - DNA, 471 bp, Homo sapiens
aaatcactattaaataggtttacatcacacaatctactacttataactttaaaattctgcttttgaatctgtctttttcaaagttcccttctttaccattctccttttggaagaagcatcctggcctccaggattccctggttatcatcaacacaaaacaattccactttaaggcataccagatgcattttagtgattgaaaaaactacgtcatgcaaataaccgtatctaccctccccagagaacaatcacacatcaatccagtctagtgtttcttgagcatgctctttgacatcttccctcctacttgaaaaaacaaaagtatttcaccatcaggactttgtagttctttggtccaatgctctactaatgtaattcaactccccttcaggtttctgctttgtttcccattttccgtttctccaacaattggccttttcgctctgtgctgtctgcttgccatttttccac

SEQ ID NO: 383604 - DNA, 456 bp, Homo sapiens
tattgtgtccagaattgtttccttccggtgggttcttggtctcgctaacttcaagaatgaagctgtggaccctcgcggacaccactggagacactggttattttagcaaggctttaactggattgccatactttcagatatgaacagatggcttcaacaaatcaaagttgacttatagagccaattaaagccccttgggaaaaactggcctgataccttgtccatgcagtccctgtacagggtttcctgacttgtgctaagtaaagaaggtcactttttgacaggctcaggagccccaggttaccttgggacttcaaaaggaaagggattcactcaatccatgcagttatttgcaggcaccaataaatctgtggctgggctcgaagctttaaaaggtttaatccaagattccgtataaataaaaattccagcaaagccaagttgcaaaggaactta

SEQ ID NO: 383605 - DNA, 345 bp, Homo sapiens
tgggcaacagaacaagaccctgtctctaaaaaaaattttttggctgagtgaggtggctcatgcctgtaatcccagcattttgggattacaggtgtgagccaccgcaccagccctaattttgctttctgctagcccttggctctgccatgtagttaattcctcattagcttcagatctcccagagtttcctgaaaatctccctggccccctgaagatcagaccgtagcaccccagcttctcctcaagactgaccaatatggaactccaatcacttggtggtggtctgatgtgtgtccatgctccccatccttctgagaccaggtatcaacaggagataatcacagg

SEQ ID NO: 383606 - DNA, 1055 bp, Homo sapiens
agagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagac

SEQ ID NO: 383607 - DNA, 881 bp, Homo sapiens
cccaggggcaccccctctccctccgggggcccagactcggcccaggccacgtggagtcggggagaccacgctggccatgtggcctggccttgctggcctgagcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcgagcagggcaggtgcaggccgcctgccccgccacgctcctgggccaactctgcaccgttctaggtgccgatggctgcctccggctctctgcttacgtatgccatgcatacctcctgccccgcgggaccacaataaaaaccttggcagac

SEQ ID NO: 383608 - DNA, 1363 bp, Homo sapiens
agagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttctacaacgacgtggtcagctccaagccgtgcaagccctgcacgtggtgtaacctcagaagtgggagtgagcggaagcagctgtgcacggccacacaggacacagtctgccgctgccgggcgggcacccagcccctggacagctacaagcctggagttgactgtgccccctgccctccagggcacttctccccaggcgacaaccaggcctgcaagccctggaccaactgcaccttggctgggaagcacaccctgcagccggccagcaatagctcggacgcaatctgtgaggacagggaccccccagccacgcagccccaggagacccagggccccccggccaggcccatcactgtccagcccactgaagcctggcccagaacctcacagggaccctccacccggcccgtggaggtccccgggggccgtgcggttgccgccatcctgggcctgggcctggtgctggggctgctgggccccctggccatcctgctggccctgtacctgctccggagggaccagaggctgccccccgatgcccacaagccccctgggggaggcagtttccggacccccatccaagaggagcaggccgacgcccactccaccctggccaagatctgacctgggcccaccaaggtggacgctgggccccgccaggctggagcccggagggtctgctgggcggggcccagcgtccaccttggtgggcccaggtcagatcttggccagggtggagtggggcccagcataacatacagtgccgccaccagccccctgagccctgtttccccccactactcttccaaatttgtggagacagggctcagggggctggtggcggcactgtatgttatgctgggcatgacggccatgacttcggctatcttctgttttaggtccttgatttcctgatctttctgaaggatttgtccttgggcaatctcgagctgccgctttgcatcgcccagtgcggagaacaggtccagcttgattctcgtctctgcacttaagctgttctccaggtgcgtgtgatttgtcaaaagaaagccttctggatgctgttaagatgtacccttcaggtgaacctggtatcagacccacagtacttgctgtttgagaaaaaataaaaacaaaaaggtc

SEQ ID NO: 383609 - DNA, 608 bp, Homo sapiens
taatgagtgagaatctacacgtttaatttggagggtgtgagaacatcattttcttagtttgcaaaggctactgtcacaaattcccatggactggatgacttagaatgacagaaatttgttctctcatgcttctggagactagtgtgtgaaatcagggtgtcggcaggaccacactcccctgaaggctctgggtgggaagcagagggcggccctggcttctggggtcgcctgtgtcctgggctttgcttggtctgtggccacctccctcggttccctgcctccaggttcacatggccttctccacatctgttcaaatttctctctgcttacaagacaaccgtcatttgactggccctgtgtgaatcccatccaactttgtcttaactcaattgcagttacaaagaccctattttcaaataaggttgcatgatagcttctgggtgagtatgaatttgcagggagacactcttcaacccaatctgatcgcatttcatgtatgtacagaaatcttagaaataacacagtggcactctctactgacttcctctgcttacacgaaggtaatgttcagagaaatggtatggatgcatgggatgaggatccaactg

SEQ ID NO: 383610 - DNA, 231 bp, Homo sapiens
tttacttaattggtatagattgaggatcatgcatcagcaagcagttttgaaattgttcccaagtgattcttacctgcagcctgggtaagaagtcgcagggctcctggatagtcattaagtgaactgtggtaagcactgatgtagcaggattacctgccctactaggtgccggaactgcatttacttgctcacaagtaatttttttaaatgtatgctcgcatccctgccttg

SEQ ID NO: 383611 - DNA, 367 bp, Homo sapiens
tttcagaaatgaacatagtaaatgccaaattaaccttttgtggaagtagtccccacttatccactgttctcttcatgctttgagttacctacagtcaactgcagcttgaaaatattaaatggaagattccaaaaatgaacagtgtatatttcagttgcaccttgctctaaggattgtgatgaaatctcgtgctgtcccgctctgtcttgcccggtgcatgaatcatccctttgtctagcatttctacactgtatatactacccatctgtaagtcacccagtagctgtctccgttagatggagaaaacataggtgtgtaaggtttggtactatctggggtttcagggatccactgggggtcttagaac

SEQ ID NO: 383612 - DNA, 2684 bp, Homo sapiens
caggctggtacgcgccggaacggtcttatgatgcgcgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383613 - DNA, 1289 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataattt

SEQ ID NO: 383614 - DNA, 2583 bp, Homo sapiens
cggacgcgtgggtcgacccacgcgtcggaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383615 - DNA, 1154 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggctcgttacggcgctcgttacggaggggtacgggctcgaattc

SEQ ID NO: 383616 - DNA, 1985 bp, Homo sapiens
  misc_feature (21)..(21): n is a, c, g, or t
  misc_feature (72)..(72): n is a, c, g, or t
gacagagatttcgagatgccncttggatcagggcgcagaccgttgagttctgcatagcaccttgaatgtttnggtgtagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383617 - DNA, 759 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccccgccttttcggggaatcaagtggtgtacccgggcagaaaacccccgcttcctggaggggttttctccctgggg

SEQ ID NO: 383618 - DNA, 2675 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383619 - DNA, 2376 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaattctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383620 - DNA, 2621 bp, Homo sapiens
agtgggaaaaacaaaggagcggcggccgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccgaaaatgccatccgccagaagaaccaggcggtgaatttcttgagaatgagtgcgcgagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtattttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383621 - DNA, 2630 bp, Homo sapiens
caggctggtacgcgccggaacggtcttatgatgcgcgggagcggacttaccttaccttctctgccttcggcgcgcttctcagccgggccgccgacccaaaggagccgtccgactatgtctaacatggagaaacacctgttcaacctgaagttcgcggccaaagaactgagtaggagtgccaaaaaatgcgataaggaggaaaaggccgaaaaggccaaaattaaaaaggccattcagaagggcaacatggaagttgcgaggatacacgccggagtcgatgcagtggctgccagggtccagacggcggtgacgatgggcaaggtgaccaagtcgatggctggtgtggttaagtcgatggatgcgacattgaagaccatgaatctggagaagatttctgctttgatggacaaattcgagcaccagtttgagactctggacgtccagacgcagcaaatggaagacacgatgagcagcacgacgacgctcaccactccccagaaccaagtggatatgctgctccaggaaatggcagatgaggcgggcctcgacctcaacatggagctgccgcagggccagaccggctccgtgggcacgagcgtggcttcggcggagcaggatgaactgtctcagagactggcccgccttcgggatcaagtgtgacggcagaacccgctctgaggtttcctggccatagccaccctttgaaatgctctctgtgtgttagagagatactataccctagaaactctgaacacgccagaatgctgaaatgcccttctacctttgggtttacagccccctccacataaattaagaaattcagtatttctgcactcttagctggattctaaagttctgtatagctcgtaatgatggtatttttatagcagccttttaacagaactagttaatttcgtgtatatgaatctttctcgaagatctggtcaaaactgtattcagtttcctgcccagaatgatcagattgaaggtggttggtttttattattatttagtgtgattgatagtatctagaatggcaggtggtgcataaaagttaaagagaggggaaagattacttagtttggttatacagttataaacaccatgcagtgtattcggtggactgtgctatttctgtttatcctttgggttttggtttttgttttttttttttgccttcacagtgagactgcaaatgattgttctcataacgtatattattaataaatgtggtcctataatttatactgaaattaccttaggatatttttgcataatactctcttactgcttacattctataaatttttcacgtgataattgtctttgcgtaactgggaaaaatgccgaataacttcctttattatctggaaaaattaaatttgttcatttatattttctacttactaaattgagtttttaaaaagacttagtgtgacatttgacagtgtctttcaaacgaacttctctaacaagtttatagttattttcctgtttcaacactattagaagtcttataaattatgctaattagcatggcagtcatgttacacactcttaacattgccaaagaactgttgatttcgtttgagaaaaccctgggactgtgtgtgtgtaggttttgttttgattttaacaaccaaaaatagaaataaaattagaactgcgttttaagttctaatttgcatttattaatttgtccaaaagcaagaactcttggaaatccttgaaaatataagctggaatgttttacttagccatgcaagtcatttatgtatacatccagccagctggaaatctgagaagtaaagaggtaggactggaaggaaggagaaagcttgagtctttaaggctagagcccagctgtgctgcctgccatcttctcaggaatggcagtgcgtattttctggctgaaaagtaaagcatgtatccaccgctttctcatagcctcgaaacatggagaaaagcaacttgcttttgccttggcaagcatgctaacctaagttaattcaagttttttttaacttaccctttccttcactggaagatttttccataagagaattccattgtttcagaaaataattataggggcccttccaagttctttgaaagattcataaccaactattcactattataacatgtttcccagtgtaaatgagtaaggaaaaaaaaagtgtaacaggtgcgtgcagatgaggagtgaccctcatatttaagttattttatatttgactggacattgttcagaagtgtgctttaagggacacttgttggttgtctgcccagcatctctcaagaatatccctcctgtcctccacatggttgtgcagggccatgtgtgaagacagcatgagtcttaacccctcttttattttatttttgagacagagtctcgctctgttgcccaggctggagtgctgtggcgcgatctctgctcactgcaacctccacctcccgggttcaagtgattctcctgcctcagcctgccgagtagctggaattacaggtgtgcaccaccatgcccagctagtttttttgtatttttagtagagacagggtttcactatgttggccaggctggtcttgaactcctgacctcaggtgatccgcccacctcagcctcc

SEQ ID NO: 383622 - DNA, 272 bp, Homo sapiens
gagccaagcagatacctgggaggagaatatcccaggcacagcaaatagctagagcacaggtcctaacattagagcttacttggcttgttcaagaagaagcaaaaagacaagtgcagctggaatggagtgaggaaagaatagttgaaaaggaagggctgggagcagtggctcacacctggaatcccagcgctttgggaggccgaggtgggtggatcacgaggtcaggagatcaagaccatcctggctaacacggtgaaaccccgtctctacta

SEQ ID NO: 383623 - DNA, 1088 bp, Homo sapiens
acggtcatttgtgtttgtctctctgtcaagaccgagtttttaaaaaatatgattatttttatttcttgtacctaacaccagaagatgcctaaaaagtatgaatgattactgaaacaaattaaaatacagcatttagtagtagttgtataaatgttaccagttacttcatttagatgttaccatcaatcacagaaacatgtaggctgaagcaatgaaatcataaatacagtgttttaatcttccattgtgtaaaaagatcaatttctatattgtatgtaaatgtaatataacattttaaatataggtttaatttttgagaagatacacagtatacttagtgattaaaaagttaggtatttaaatctatgagaaaatgggatcattatttggatatttaccagtgctaatcgaagcagttgctggtaaaggcgttggagttgatgcatatagatagaagttacttttgcaataaaacattagagtcaccatcagaacagaagacttgaaaaattttatttgactcaaattacaaactgagcatttatgggtgtctgtgtgtgcatagcactgaattagatcatctggagatacaaaagtgtgatagatgctttcaatataaaataaacgttacatagctactgaacaagacattatataaaggttcgttaatgacctaagatgtaaatttgtttataatttttatcatagttcaatttcatctaaaccttatgtgatttcagtgttttcctcagatttgtctcacactctagtctggtgatttccaggcttgtgcctgtcccagcacacctaaggaagagggaaaatgtccatcaataagtaacaggggtttactttcagtggacagggtggatggaaggagagatgagcaaatttggggtgaaaaataaaagccctccagtggttctgacaagctgtagctagaggggggtggcagttgcagaaggggcagtttctccgtcttgtattttttatttttttctttgattcttgaaaataagttcttatttttgataagatggaggattattattattattattttgagacagggcctcaaaaaaaaaaaa

SEQ ID NO: 383624 - DNA, 340 bp, Homo sapiens
aaaagagaggatttttaatgttcccaacacaaagaaataatcaatgtttgacttgaaggatatgctgattgttctgatttgatcattacacatggtatccatgtattgaaatatcacactatgccccataaatgtgtacattacatatcaactaacattaaaaggaaataaataatgtgtataacttttctcctattaatctattatcagttgatttcagcagactcagttatagaaccttcagagggcagaggtaaagtaccttttgccctgacaattcaaacatagctttagtcttcctaaatgagggaaaaaagtatgaaaagtgcttcaaaaatac

SEQ ID NO: 383625 - DNA, 480 bp, Homo sapiens
aactaaagttgcatgtaaaacttatagggaacataaacttggataaagtggaccatcaacttagacttatttgatgtcaccttgtcaaggagtgaaaacagaaagcaaaactgataaaaacacagacaccataatatcatatactatggaaataatttaaagacagttactaaattaattaaataacgctacatgattttttaaaacttacataagtacaattgcacttctgtttgttgatgtttaagtctctattcccaacttgatactcaggaaaacattacaccaaaaagtaaatagatattctaattcaatgcatttcatttaacgagcactaagtccaaagaaacacattactaggtgtttaattttctaattcaaagtgtgaaaattacatctctcttctgatttgagatcctcattcacactagggcattcagaaaaagatgttccccatcatatgagaattaaagaatatgt

SEQ ID NO: 383626 - DNA, 498 bp, Homo sapiens
ccaaatgtgagaaatctgaaaggaataaaaaatgctagtccttaatgttagccgtatggttggtgttagccaaaatgaagttcaggctgtgatgctctgtagccactgtatgacctacccaaaggcaatcagaactcactcgtttcttccttttttcttttcttcctcttttttttaaactaattggcccatgtttagtttactgaatgtcatctggactcagtaaaaagcaagtgacctgcattgaattagtgtaattgtaatacaaacagaatattgcatagttttggtcttatacaggaaaggagaaagttggaaagatttttctgtttgataaatagaaactgaagatgtgggaatccaggcctggttcatacttgattttacctttcatgtctctttgtaagatcagtatttggacttttaggcatttttcctctgtaaaaaaacattggttttcattttgaaatttattatgaaagaagtctgctttttgta

SEQ ID NO: 383627 - DNA, 448 bp, Homo sapiens
gggcacttctgtatgttgtctccttgaagtgtcacaatcactttgagacagaattagttttgttttagtcattatacagatggggaatgtgggtctcagttaagtaaattactcaggagacacgccaagagctggatctctttaacgccaaaggttaacctataaactaacgtgctacaccgcctgtactggcaaaatagaattaccataaaatgaaatttgcttccacaactgggcatgtgagttcggtgaggctggtgttacccattgctccatgggtcagaaattggtcttgctgaagcttggaaggagaagctcttggctcagggagtgaaaagttactgacaggttatatgagtgcaattgaagggttatgcgtccatagagcatgtgatggaatgagaacagagagaatcaaagagaatcacccagagcagactctgtctca

SEQ ID NO: 383628 - DNA, 359 bp, Homo sapiens
agcagctctgagtgaatgaagccataaactcaagcctgtgtctcatttgacactctgccaaccaccatgtaaatattcctagtacttaatgtattaatcgagaagaagagagaaactgggctcattatacatcccacatttgtgtttctctttaatacagtaaaagcctcttaagatattttccaggagagcaaccactaacgtcatcttgccagaaaaaaaacatctcaggggagagaccttggtgagcttcagactcagaatatgtatgtggaggcctatgcataggtatatatatgtttaattagtgtggtttcttgggaggacttttctataatatcaaattaaaatccagtaag

SEQ ID NO: 383629 - DNA, 1959 bp, Homo sapiens
gtagggaaactgtgagggcggcaccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctcaaaaaaaaaaaaaaaaaaaaaaaaaaaaaaaaaaaaaaaaaaaaaaaaaaaaaaaaaaaaaagggtgaaggagaggatcttatttgcggggggtgggaccaaaacaagaggtgtgcaaagagagcggacgagcgtggtaaagaaatgagatgtcaggggacaagccgcattttttgttgaacaaaagagggggataacaacgaggggagcgccccactttagaggagggcgtttataattgagaaagcggcgggttagcgcggttttagag

SEQ ID NO: 383630 - DNA, 1870 bp, Homo sapiens
ggtcgtaccactgcactgcagcttaggcaacagagtgagaccctgtaccaaaaaaataataatataaactaaaataaaaggtgagcagggccaggcacagtggctcaggcctataatcccagctctttgggaggccaaggcaggaggattgcttgagcccaggaattcaagaccagtctggacaacagagtgagaccctgtctctacaaaaaaataaaagtagctgggtgtgatgatgcatgcctatagtcccagctacttgagaggctgaggcagaaggatagcttgagcccaggagttcaagactgcagtgagccatgattgcaccagtgcactccagtctgggcaacagagcgagactctgtctccaaaaaaagcaaaaaacaacaacaaaaaaaacaaaggtgagcaggaggctctcatcctccctcctctccccacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctca

SEQ ID NO: 383631 - DNA, 1592 bp, Homo sapiens
gtagggaaactgtgagggcggcaccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctca

SEQ ID NO: 383632 - DNA, 1689 bp, Homo sapiens
gtagggaaactgtgagggcggcaccggaagtggcgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacagaagccttgtactacacagatgacacagccatggccagggccctggtgcagtccctgctagccaaggaggcctttgacgaggtggacatggctcacagatttgctcaggagtacaagaaagaccctgacaggggctatggtgctggagtagtcactgtcttcaagaagctcctgaaccccaaatgtcgcgatgtctttgagcctgcccgggcccagtttaacgggaaaggctcctatggcaatggaggtgccatgcgggtggctggcatctccctggcctatagcagtgtccaggatgtgcagaagtttgcccggctctcggcccagctgacacacgcctcctccctgggttacaatggcgccatcctgcaggccctggctgtgcacctggccttgcagggcgagtcttccagcgagcactttctcaagcaactcctgggccacatggaggatctggagggtgatgcccagtccgtcttggatgccagggagttgggcatggaggagcgtccatactccagccgcctgaagaagattggagagcttctagaccaggcatcggtgaccagggaggaagtggtgtctgagctagggaatggcattgctgcctttgagtcggtacccaccgccatctactgcttcctacgctgcatggagccagaccctgagatcccttctgccttcaatagcctccaaaggactctcatttattccatctcacttggtggggacacagacaccattgccaccatggctggggccattgctggtgcctactatgggatggatcaggtgccagagagctggcagcaaagctgtgaaggctacgaggagacagacatcctggcccaaagcctgcaccgtgtcttccagaagagttgatgagggctacagctgttggggctctgccaggtcccctgggaccaactacagctccaatcagaaaccctgcgcttccttgagtgtggcttcccacttttcctgcattgtggagctgactgagtacaccggtgaggctggggtctctgcaggggaggtcactggaacagcgagcaagggactggtgcctcgctggtgctgggtctctggtttgctgcagagccgtaggacactcctggctcctcagtaggacagacagacgcaggcgggtttattttggaggggtacttgtggcattttcctgtattgtcttggacatgggatgtggggaggtggaaatgatgagcagtagcatcatttctccctgttgggttttagccagtttgccagcaagcgcatcctagcagggtccccgagcagcaggttgtgtggatgaagggacaggcacttgcatccagctgatctaggtcacacctggctcttggctgccatgtggcttattaacagcttccagtggaagtcgcaataaacagtttttggtaaatctca

SEQ ID NO: 383633 - DNA, 819 bp, Homo sapiens
  misc_feature (29)..(29): n is a, c, g, or t
  misc_feature (36)..(36): n is a, c, g, or t
aagtggcttgggtgtaacccgcgcctccngggttancgggatgagcagtctgcgcgcggatggccgcagcggcgatggcggcagcggcaggtggaggggctggcgcggcccgctccctctcgcgcttccgaggctgcctggctggcgcgctgctcggggactgcgtgggctccttctacgaggcccacgacaccgtcgacctgacgtcagtcctgcgtcatgtccagagtctggagccggaccccggcacgcccgggagtgagcggacaggtgggcggggccgggcgcaagtcagaggccgtgcgggagggaggccgaaggggcgcggagcctccgggggcgacgggtcgggggtgcgcggggatgaggctgccgagggcaccggggccagagccggatgacccgcagacagcttgagctcagcgagtgccagtgcgatctccggccttatagacgtctcgccccgaacatcccgtgctcggggcgtggcagcaccggggcctcaaccgtgcagggtgtggataaacccatcgtaagttgaaaatacctgaagtggaaagtgcgctttcagcttagacgaccgttttatctggacgcagccccatcggacgtcgaggagcctatgaatgcgtatcagcgttatcagaaagccgaaaaaaacttaagttgaaccatcctaagtcggggactgtctgtccacccttgccgacttgacctctttttcccggttctctagagtcagtataccaccagcccgttctccaccccgcaaggcgtgctttggaagcctgactctaatcgcgtcctcccctgcctaaa

SEQ ID NO: 383634 - DNA, 1066 bp, Homo sapiens
ggccggaccggggccatggcgcccgcgcaggccccgctgctcccgctgctgctcctgctgttaccgctgccgccgccgcccttcgcgccccccgaggaccgccgccgcgccaactcggaccgctacgccgtctactggaaccgcagcaaccccaggttccacgcaggcgcgggggacgacggcgggggctacacggtggaggtgagcatcaatgactacctggacatctactgcccgcactatggggcgccgctgccgccggccgagcgcatggagcactacgtgctgtacatggtcaacggcgagggccacgcctcctgcgaccaccgccagcgcggcttcaagcgctgggagtgcaaccggcccgcggcgcccggggggccgctcaagttctcggagaagttccagctcttcacgcccttctccctgggcttcgagttccggcccggccacgagtattactacatctctgccacgcctcccaatgctgtggaccggccctgcctgcgactgaaggtgtacgtgcggccgaccaacgagaccctgtacgaggctcctgagcccatcttcaccagcaataactcgtgtagcagcccgggtggctgccgcctcttcctcagcaccatccccgtgctctggaccctcctgggttcctagtcccagccccgcaggacgccgaccctgcctggacggccccgcctggaccgcctgacctcggccctccggacccggctgcggcccccgcctccgagaccaaatagagacgctgcttctccctcgccaggagccgcccccgccgggcaggggccatccacccgccccaggaccagccctcagggaggggaaacggccgagagcccccccccggagcccgaggggccggggtgtggatgcggaccgtggccaggccatctcctctggggcgtcggagaacccgggcccgcgggccggttgcactcccagcgcttgaagcgggctggcggtggtcgcaggaggcgtggccctcgccgttgaccatgtacagcacgtagtgctccatgcgctcggccggcggcagcggcgcccc

SEQ ID NO: 383635 - DNA, 336 bp, Homo sapiens
ctaaaaaataaaaacacaaataccatataaatgaagttctcttctcatatatcagcaggtacaagatactcacatgataactttatttggctaagttggtgtttgccaggtttctctatagttacttttctttcccccctttcttactctagtctatatgaaagccagtcactaaatccaacccacacttgggaagagagatgggagtaagagagaattaagctttacttcctttctagagtgggaagcgtctacttaaattatttggaattttcccacaaggaagatgtctctcttctctatttgtttgtttagtcactcatatgtatttatatg

SEQ ID NO: 383636 - DNA, 862 bp, Homo sapiens
atgtgtccaaaaaaactccagtgtggttctaggatgagataataaaaacaggttgtctagggtagtgtggaaggtcctttcagtcttcctgtgcctatcagtgatcctcattgccatgttcccttctggtgctcaaccggaggctccctgacagatgagtcctctgccagaggaaggctaagatgtagaggacaaatcgtgtcaaggaaaagaagcttgaaggagctaagaatgcttagcttagagaagacaagaggaaacaggacatggctttgggaagttcaaggatggtccagtgaaatacatactatacttttgcaccccagctaagctgacccatgatcagtaagtaggaaataaaaggccaatttctggctactcttgcccccaaccccatttcagtgaactatgaacctctattagatatgcaaggccggtgctaaatgctggagggctttggccctttccctcaaggagctagtctagtagggggtcagaaatacagatgggcctgaacataatgatggtttgacttccagtttttcaactttaggattgtgcaaaagctatacacattcggtagaaacagtacttcaagtatccatacaatcagtacagtattcaataaattacatgagacattcaacactttattataaaataggctttgtgttagatgagtttgcccaactgtaagctaatgtaagtgatctgagtaggtttaaggtagcctaggtgtattaaatgcatttttcacttaacggtattttcaacttttgttgggtttattgggatgtagccccattataagctgaaaagcatctgtagtataataaatgtggggagtgctgtgagagaaata

SEQ ID NO: 383637 - DNA, 191 bp, Homo sapiens
atgtgtccaaaaaaactccagtgtggttctaggatgagataataaaaacaggttgtctagggtagtgtggaaggtcctttcagtcttcctgtgcctatcagtgatcctcattgccatgttcccttctggtgctctacatcttagccttctctggcagaggactcatctctcagggagctccggttgaggtc

SEQ ID NO: 383638 - DNA, 501 bp, Homo sapiens
atgtgtccaaaaaaactccagtgtggttctaggatgagataataaaaacaggttgtctagggtagtgtggaaggtcctttcagtcttcctgtgcctatcagtgatcctcattgccatgttcccttctggtgctcaaccggaggctccctgacagatgagtcctctgccagaggaaggctaagatgtagaggacaaatcgtgtcaaggaaaagaagcttgaaggagctaagaatgcttagcttagagaagacaagaggaaacaggacatggctttgggaagttcaaggatggtccagtgaaatacatactatacttttgcaccccagctaagctgacccatgatcagtaagtaggaaataaaaggccaatttctggctactcttgcccccaaccccatttcagtgaaaaatgcatttaatacacctaggctaccttaaacctactcagatcacttacattagcttacagttgggcaaactcatctaacacaaagcgtcgacg

SEQ ID NO: 383639 - DNA, 784 bp, Homo sapiens
cggcctgtgggccacgggttgggcaagcctgctgtgataaccattgctgtagtgcttgtcatctttgtaggaaggcgtgtagtgaggcttacaaattttgaacttgggaatgtctgtctgcctccgtcacatgggagctgagagccatattgaaatggtgctcacgtggtggatagaatagggtcttcaggctacgtgggagtcatagaggctacctgagagagaacaggcttttcttggttcagaaattctaggtttgagaaggaaagcctacatacagccatctccacactgcacaataggtgagcagttttcagcagacatctccacattggtgttcttattggtctaaatgtacacctggtcagaaatggttttcatggccccagatgttcaggaagagctacatgaactctgttgatgatgtctttttaattgttagacattttggccactgttcctggatcagcattttttgggcagacccattttcttaacaaactgtactctctgaggcagcttggatctatccaggaaagtttccactagttaatttgcatagctcatgttgacattatggagactcaacagtttatctgcagggtgtgaaattggggtattagtcagcaccataaggcagaaaaggtggccagacccactctttggactctggatcctggatttactgaaaccgcagataccctgagcctgaagatgccatgtccagtcctaatacctggttcctggaacccacctccaccactgttgccacttgaacaataaa

SEQ ID NO: 383640 - DNA, 782 bp, Homo sapiens
tctgcaacatccttttggttaaggtcagccctctccagtgtgagagcatactgcccaagggcttgaataccaggaagcaaagatgattggggtcattttggaggctgactactgttctctgcgctgtccctaagtcatgtcctcccacatgcacagtacactcctcccctcccaaagcccccaaaagttacatcccattagcacatcggtccaaaatcttatcctccaaaagcagcatggatttatactcctcaagtgggtatttctcgcactgtcacccagggctgggagtgcagtgggcagtatcacgggcttcactgtaggcctcgacctcctgggggcttagggcaatttcttccccacttcagttttcttcaagtagggtgcatggccacagatgccagactaatttttttaagaagcagagtctgctattttgtccaggctggtctcgaactcctggactcaagagatcctcccagcgcagcctaccaaactgctgggattacaggcatgagccaccacacccatcctaagatttcttgagtatagccctttgagtacaattttttgccccaacaaagtctagtggagtaggcataggagaattggtagaccctcccttttaaacaggaaaaatgatgcctatagtcccagctacatcagaggataaggcgggaggatcatttgagcccaggagtttgaggctgcagtgaggtatgatcacacctgtgaatagccactgcactccagcctgggtgacatagcgagagaccctgtcc

SEQ ID NO: 383641 - DNA, 325 bp, Homo sapiens
ctagaatatgcaaatgaactgtataatttatgagtgccagtgtctgtctaagagtgtttcacataatttacaaagtgagcctgagaggcatgaggaaggcagctcttccgattccattgccaggaaagcgctatatatttttctgtaagtgatccctcataatatcatcaagtgctatttaaaagaaatgaagatttcaaatgtacatgaaaggcaaagattttcctctcacttccttcacccattgattttttttcctaaaatttgcaagaaacttggactctaaagccttaaattttggatttaatttggaaaagaaaagtta

SEQ ID NO: 383642 - DNA, 770 bp, Homo sapiens
gcgaataataaccaggcgaataataaccagagtagctacactgacttttgataagatggacttgcatcttgtagttactcaattacacagttaaaaaggattgcctaatgatggtagaaggttaatttcatcagcaagttaaattgtagaagagctcaaaatatgtaaaacaagcagatgaaactttacagagaaattcaaaacactacccttagtctggaagccctcttctctcaagagctaaacagaaaacgaatgaagatagagatttgaacacacttcttcatgtaagtatttgtttcctattgctgctgacacagtaccacatacttagtggcttaaaacaatgcaggctggtacactggctcacgcctcttatcccagcacttttagaggctgaggcaggagcatcacttgagtccagaagtttgagaccagcctgctcgacatagaaacaccctgcctctacaaaaaaaaaaaaaaaaatttttaaggcagggtctccctctgtcacccaggctggagcagtggcgtgatcttggctccctacaacctccactcctgggctcaagcagtcctcccacctcagcctccctagtagctgggaccacaggtacttgccaccacacccagctaattctacaagaaaaatttaaaaaataagccatatgtagctactccagaggcggagttgggaggatcacttgagcctgggaggttgaggctacaatgagtcgtgatcccaccactgcactccagccctgcctcca

SEQ ID NO: 383643 - DNA, 485 bp, Homo sapiens
gataagatttattgagatacatacccatagaattgcctcataggacttcttgcagcactcaatctagagtgaatccctgtttacttagaccctcttccaaatcatgtaaaccaaatcccaaatcgtatagtgggttctttcttacattcttatggagacaccagtggttccctgtggtgtgagttctctcttgccatgagtaataggcccagctcattcaattgtaagagtagtacaatcagcttacaatttttcactttcaaaagtctgtgaatattgtttccaaagtcttctacatctcactttttcaagaggaggggtcacagactaaaatgtttcttcttcctttgtaggtaagatgttgtttcgttttgctttattttcttcctgcttgcttgttaaattatatcttgatatcgaaaattaaactgttttttaaaccaggtgttcacttttcattgatttttgcatagtacttggtgaac

SEQ ID NO: 383644 - DNA, 659 bp, Homo sapiens
gcgcatcagcaaggtctactcccgcgagtgaccacgggacagacgatcctctgaggtttccaggaagacccccgccctaatcctctgaaggtcggaggtcacaggtcaaagccgagaacagaagctggggtggggcacacagaggtggaaagaggggcctgagcatcgggcggccaccagcagggtcccctcctggccacaaggacgctcccgttccagtccccggaagagggtggctgcagccaccccggggatgaccagcagaggtcctcacggcctgcggcccggggagacctgagactcctaagctgagcacgtcagcgtctctacctccaccgcagacagaaagaccgggcggacccaagactgcaagctcaagccctggcggcagggcagcggggcctgtgagggccgagggtggacgctgctctgagccagacccgctcgtcagcagctcggcctcccccgctgctccccaccagcgcccgggcttgggtgtttggtgcttccaacttttcaagagaagcttgaaatctgtaattcttatgtgaaatcctgcctttcttaactaattaaagacttaaaattagctagttaaaattaattaaaattgattaaatttgtactaattaaaactaactgaattcttctcaaaacac

SEQ ID NO: 383645 - DNA, 736 bp, Homo sapiens
gttaattatagctaatgattatgtgcagtcagcctgacatctagccacagtaaactcctgttttcttgggatccaaacaccctgtgttttaccattagttttgttagtattgttaactttctttacacaagtaaaccatttccactaccaaaggtttagaaactatggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttc

SEQ ID NO: 383646 - DNA, 887 bp, Homo sapiens
gttaattatagctaatgattatgtgcagtcagcctgacatctagccacagtaaactcctgttttcttgggatccaaacaccctgtgttttaccattagttttgttagtattgttaactttctttacacaagtaaaccatttccactaccaaaggtttagaaactatggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttctttgcctgtgaaagtgttgcctctgtaagtcactaacaaccttctgccagcagttgactgtctatcttggatcagtgcggggagtctaagacgaaagagatgtgaaccttgccctcaactcacaagagagagacacctaagagctttttaa

SEQ ID NO: 383647 - DNA, 4626 bp, Homo sapiens
  misc_feature (1857)..(1857): n is a, c, g, or t
  misc_feature (2948)..(2948): n is a, c, g, or t
  misc_feature (4188)..(4188): n is a, c, g, or t
cttgaagatattaagtgtcttatcaggctagttacataaaggaaatttcaactgggatgaaatactagcatctggatcaaaggtgaaaagactccatttatttctaccaattcagacaatgcagtgttatacatacactgaatgaatattctggatggcattgatttggcaaaacaaaaacaaaccaatacagcaataactgctcccttggaaaagttggtggattcaaaatcatgaggttccctcaccccccatcctgagccaaacaaaacattctttacctgctcagtcatacctggtaatttcacaacgattaggtgatcgtgttccctgactctcatcggcagcagggctcctggaagtcctgcttctcattactactgtggactggagcctccccagagctccctggggtccttggcctgggtgaagatggatgaagatcagatccagcagctgtgggtagaggagggtccaggaagcaggcacaaagagaggtaattcatccacatggcaaaacagagcatgatctggggaagctggaggcctcccaaacagggtaagagagagcgatacccttccattttcagctcagatttctcttttgcctcccttgctccatgtgggcctattctagtcccaacctaggtgtcagattccctctcaaccgctggttgttcactggttcctcaaccagaacccacatcttggcctatgaaagttattaactccttcccttctacccttttctgtttctgctcaccaggaaacagtggttccgccaaccactgtggtgtttggaaggactaaactggatttgactttattttggccactgttttgctctgtgagtttgtatatgcgactcttgatctctatagctaattttctcatcagtgaaattgttggttgaactacccataactggcaaataggtctctttataaacaccaattcagaaatgctgttagtggcttcttgggtctctgtgtagagaaggatcctgaggtatgccgaggttcaggagagctagcacagtgggaccccattgcctgtagaacagttgctctcaaactgtagtgtacaactcattatctggagagctcattataacacagattgctgggtcccacacccagagtttctgattcagtaggtctggggtgtggtctgagaatttgtatttctaacaaatccccaggtaaggctgatgctgctggtccagggaccatgctttagaaacaccactgtggtatttaatttcttatggctcagtttggttttcttgaaacaatgtcagcctcatcaccagctagctgacgcgaatagacatagggatgcaaacttctttaagggagtttagagatttattaaataaaacaagttgcccatctggctttaaaaaacagagtagtacacctctaagcataaaattctatgattttgtagttcatatttaactagtatggtgagacagaaaatctatgggcttttgagtcagatttagccgagtttaatcctggctctatggtttaactatttgaccttggaccagttaccaaactcctcacctttaatttacacagtaaattcacaatctttttgttttctctcattgttctatgctcaatgtctaatttatagaaggcaatcaaaaatattctttgaatgaatatgcaataatctgtaatagacaaatctatagacccgcagaaattattttctctttttgtcctctcagggtgtggggattaacgaataaattctaaaggagctttcaagaacagaaagccaaacaccagatgttctcactcataagtgggagttgaacaatgagaacacatggacaaagggagnggaacatcacacaccagggcctgttggggagtggggtgctaggggagggatagcattaagagaaatactgaatgtagatgacaggttgatgggtgcagcaaaccaccatggcacgtgtatacctatgtaccaaacctgcacattctgcatatgtacctcagaacttaaagtatatataaaaaaaaaatgtcatctttaaatatgcaggaagtctgaactctatattatgactcaactgtggtaagaaaatgtagcttcttcctctctaaatcattctatgaggccaacatcatcttgataccaaaacctggcagagacacaacaaaaacagaaaactttaggccaatatccttgatgaactttgatgcaaaaatcttcagtaaaatacttgcaaactgaatccagcagcacattaaaaaggttactcaccatgatcaagtaggctttatccctgggatgcaaggttggttcaacatatgcaaatcaataaatgtgattcatcacatgaacagaactaaagacaaaaatcacatgattattacaatagatgtagaaaaggcttttgataaaattcaacaccccctcatgttaaaaactcaataaatcagtattaaaggaacacatctcaaaataataaaagccatctatgacaaaatcatagccaacatatactgaatgaggaaaagctgaaagcaccccccttgaaaactggcacaagccaaggatgtcctctctcaccacttctattcaacatagtattggaagtcctggccagaacaattgggcaaaaggaagaaggaaagggcatcgaaataggaaaagaggaagccaaaccgtccctgtttgcagatgacatgatcccatatctagaaaaccccatagtctctgcccaaaatctccttcaactgataaaaaaacttcagcaaagtctcaggatacaaaatcaacatacaaaaatcactaatactcctatacaccaataacagtcaagccaagagccaaatcaagaatggaattccatttacaattgccacaaaaaaataaaatacctaggaatacaggtaacagggaggtgaaaaatctctataagnagagctacaaaacactgctcagagaaatcagagattacacaaacaaatggaataacatcccagaatcaatattgttaaaaatggccaacccaaagtattttacagattcaatactatttttatcaaactaccaatgacattcttcacagaactagaaaaaaactcttttaaaaattatatggaaccaaaaaaaagaaaaaagcccaacagctgaggcaatcctgagcaaaaagaaagctggaggcatcatgctacccaacttcgaaatatactacagggcaacagtaatcaaaacagtacggtattggtacaaaaacacataaaccaatggaacagaatacagagcccaggaaaaaggctgcacacctacaactatctgatctttgacaaagtcaaaaaacacaagcaatgggaaaaaatactcccttttcaataaatggtgctgcaataaccatctagccatatgcagatgactgaaactggaccccttccttacaccatataaaaaagttaacccaagatggattaaagacttaaatgtaaaatccaaaactataaaaatcctgaaagacaacccaggcattatcattctggacataggaatggtcaaagatttcatgacaaagacactgaaagcaatcacaacaaaagcaaaaatgacaaatgggacctaattaaactaaagagcttccatacagcaaaagaacctatcaattgaataaaaagacaacgtacagaatgggagaaaatttttgcaaactatgcatctgacaaaggtctagtgtctggcatctataaggaacttaaacaaattaacaagagaaaaatgaacaactgtattaagaagtgggcaaaggacatgaacagacactttcaaaaggagacacacatgtggccaacaagcttatgaaaaaaagctcaacatcactaatcattagagaaatgcaaatcaaaaccgcaatgagagaccatctcacatcagtcagaatggctattactaaaaaggtaaaaataacaggtactggcaaggttgtggagaaaaaggagcacatatatattgtcggtgggagtataaattagttccaccatggtgaaaagcagtgtggtaattcctcaaagacctaaaaacaaacagcaatcacattactggatatataccaaaggaatataaatcattctatcataaacacacatgcatgagtatgttcattgcagcactattcacaatagcaatgacatngaatcaacctaaatgctcatcactggtagaatagataaagaaaatgtggtacatgtacaccatggcatactatgtagccataaaaaagaatgaggtcatgtctttgtagtgacatgaatggagttggagaccattatccttagcaaactaatgccggaacagaaaaccaaataccacatgttctcacttataagtgggagctaaatgatgagaacacatagacacataaaggggaacaacacacactgggggcctacctgagggtaaagagtgggaagaggaaggggatcagagaaaataactaatgagtactaggcttaataccttggtgatgagataatcaatacaacgaacccccatgacacgagtttacttatgtagcaaacctgcacaaacctgcacctgaacttaaaatataagttaaataaataaaaaggg

SEQ ID NO: 383648 - DNA, 703 bp, Homo sapiens
ttcccagcactttgggaggccaaggcaggtggatcaactgaggttgggagcttgagaacagcctgaccaacagggagaaaccctgtctctactaaaaatacaaaaaattagctgtgcgtgggggtgcatgcctgtaatcccagctacttgggaagctgaggcaggagaatcacttgaacccggaggtggaggttgcggggagccaagaacgtgccactgcactccagcctgggcaagaagagtgaaactcagtctcaaaaaaaaataataataataaataaagggcagaaatcaataacattgaaagcagaaaaacagagaaaatcaatgaaacaaaaagctggtcatttgaatagaatcaacaaaattaataaattttacgacaaagataaaaacagagaagacacaaaccaacaacatcacgaataaaacaggggttatcaaaaaggctcctgcagccgttaaagagtattaagcaaatactctaaacatcaccctcagactacccaagctggtctcttcaagaaggcactcagtgcaacttccacttccctaacaagacttgaaacaccttgaaaatcataaactaccaaaattcaggcaagatgaaatagataatctgaatcgtcctataaccattaaagaaataaaatttgtaattaagagcttctggaataagaaatctccaggcccagatgatttc

SEQ ID NO: 383649 - DNA, 614 bp, Homo sapiens
ctacatcaaactgatttgaagtcaatttaagaaactccctagggtcttaaggtgtggtccacaaatcagcaacaccgacatcacatggagcttgctgggatggcagagtcctaggccccactgcagactgctaaatcagaacctgcatttcaacaagattcccatctagcttgcatgtacactgaagttggagttataagcactgttataaagagtaaatttatcttaaaataatgctgctgttgcaaactttaatcagtgtaactgcaacactaccaacatgaattatttatcctcaactaagttcagtgtgttattttattgaaggtgtagccgggcacggtggctcacgcctgtatttgcagctctttgggaggccaaggcaggcagatcgctggagctcaggagttcaagaccagcctgggcaacatggtgaaatcctgtctctacaaaaaatacaaaaattagctgggcatggtggtgtgtgcctgtagtcccagctactgggcaggctgaggcgggaggatcacttgaacccaggaggcagaggttgcagtgagccaagatcatgtcactaaattccagcctgggcaacagagcaagactgtgtctca

SEQ ID NO: 383650 - DNA, 272 bp, Homo sapiens
tgaaaatgatgaagtaattccaattctgctgatagagacctggaaatgcactagggaaaaatgacaagagtgtaacacactgctgctgattatgtcataatgattattttatgcagtttgaagaagactcactgttctaaagaaccagcatccatttccaggaaagagcagggattctccatccatacctccatgggatgaaccacattgaaaataatgatttccttctaatagcttactctacattatataaagaattccttgggattcta

SEQ ID NO: 383651 - DNA, 970 bp, Homo sapiens
gtcaggacatcacaaaacatctgccaacatcgaaaagtcatcaggagccacccagacgtggggtgtattggtgggaagaaggagcatcttagtctgcttccttctgaggcccacagttccagaaggactagcgtcctcagagcatgtggtagtggctgttcttgtcttttcctggtggtggggcctggtgacccctaacaccaacggagctgttcccaggttcatttcgtccctttttctgtggtgagatgaggctcctcctgccctccttgctgggtggtctttctgttttgaccacatcccttggaagcgtggctgggctgcgtaactccagagcagcctggtggtagctggggctgccttctgagtttgggctggtggatgctgagtatttgcattcagagccttaggcattgaccttggctttctgggaccctacgcccctctgtttgcctttgtcagtagagaccttctcacatttagggattcattttttccaagatctgtttgctaggtgtgtgtcaaacttcctcccagagcagtgacatggatgggaattgtgagtgtgttgagagacctaccctaaaagatggggctgcagtcatcctcaggggacctcctgttctcagctccacctcagccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaattgccggtaatcagccccagccatttctcagcatttctagtttggaacttcagagacttcaacttacgattcctttaaggcaggagtttctactttggcactgttgacattttgggtctggtggttcttca

SEQ ID NO: 383652 - DNA, 400 bp, Homo sapiens
tgcacaccccgagtctccacactttttcgggtcaggtcacactggacgaagttgttgacacgccgtagacccacacttggctgtgggtcagcttcttctgaatcagcatccgcaggacagcgccacccagccctgccacacttgcttcctccgcgcttcttcagaggctggagcccacccccatgctcgtcgtctgttctgcttttttgatgcacttacttgtccctttcagcgtattgcttatgtcctatgttggttaaaaaaaaaaattgccggtaatcagccccagccatttctcagcatttctagtttggaacttcagagacttcaacttacgattcctttaaggcaggagtttctactttggcactgttgacattttgggtctggtggttcttca

SEQ ID NO: 383653 - DNA, 461 bp, Homo sapiens
gggcactatccctcacattcacgatgtctagcatccctaatgcccttaatgaataccagctgcagccctattcatcgtaataaccaaaattactactgaaaatttcccaaatatcccctagagggaggtatgcatatacattgagaatcaagttttctaaatgcctgtagctgtgatattcccattcctggtcactagagggaggaagtagtctttaggatgatagtacgattctgttttgtctgccctcaaagttcaagtttaagctgatatagatcagcttggcaaaaatagatcatatttcagtaaaataactgtggcatagtttctcacatatgtttggtactctttattattacaatggaatcacatttctattttatttaggctatcactgttacaaaagtaatattttctcaggctaattatctagttatgatcactgcctgtgataatacttt

SEQ ID NO: 383654 - DNA, 398 bp, Homo sapiens
atgaaaacctttgcctacaaaaagagttgtaaacaaatgttggtggcagctttattaacaatagccaggtactggaaacaacctaaatttccatcagtaggtaagtaaaacaaatatacaccttagacaaaaataaatttcagctagattagatatttaattataaagaactaaattaaagtactagaaaacaataaagaatatgatattggggttgagaaagggattttattcgcttgataccaaaccataaaagaatgaaaaatgttatcttttggcccagcacagtggctaatgcctgtaatcccagtacattcagaggctaaggcaggaggatctcttgagcccaggagtttgagaccagcctaggcaatattggaagaccctgtctctacaac

SEQ ID NO: 383655 - DNA, 367 bp, Homo sapiens
gcaggagaggagaggtagttgggattcaagatatgaaggaaatacgcaggaagggagcaagagtagcaaaaattgcaaagctgtgagatagagaggaaatgcaggaaggatttcaaagcagagtataggcaaagaatgcctggcatacaatctggagaggaaaaagatggggaaaggaagtaggaagtgaaaaccgagggaagtggaaaagaaagtgaacatgtggatggtttggaagctgtcctcaaaaagtagaaatgtggcctggaatctatacaacacaaacgaaagggaatacaatgtttggggcaggagaggaaacacctgcttaagaagggtatttgaaaagtcagagccacacccagac

SEQ ID NO: 383656 - DNA, 348 bp, Homo sapiens
ggaggttgaaacatgcattcttgccactgggacaacatgaggcctctaacagcacgggcaggcatggggtcccctgggtggacgaggccgcttggcagccaggtttggagacctggcctcctggtcagctttggagggcccctcaacagagctggagccctgcaccccaacacggctggccatgtggcctcagaacactacttattactcaatgcctggtacttggccagccccagcggtcagtctataaatactcactgacaaggtggagggctggacggccatcaccactccccagacgttctccattgcctgtctcatttccctccctccctctgacacctttct

SEQ ID NO: 383657 - DNA, 255 bp, Homo sapiens
ccatggtatgttttcataattaacatgcaaatagatgtatagtttataattaatttcaactgggcacagtgaaaatcttgaaaacctcagcatggaggcatctttgttggtagaaattcaatgaaatccccaaacatctttggttttgcaatccataatttgcagattattaatacaataaatccttgttgtctgtgagagttggcatcgtacccatgaactcctgtgtagaaagcctacaaactaaaagtccaa

SEQ ID NO: 383658 - DNA, 356 bp, Homo sapiens
ggggggtgctaatatgagcagggaccctgctgtctccctgcctgcccccgtcccacgcccaagatctgcccttgggaggaggcgcatacatacacaggacatacacagagcccatctactggctcctgtggctgctggagctgatggtctgtcctagtggtggggctccctgtcgccctgtacgtgctgggaagggggagtacctgcccacctgttgccagtgccagtggaggaagctgtgtatgagcggatagggggcccttctccgacccttccatgaggagaagggactgtctgtcccaggatggagctgaggggagggaggtgaccaatgtctgtccatccagaggtctgta

SEQ ID NO: 383659 - DNA, 299 bp, Homo sapiens
atagctgtggtggtaacccaccagagtgagcatgcttgcttctgaggatagacggagggtagtgggattggggagaggcaggacagaggcttccgttgtgtctctctaattcattgtttcttaaaaaggatttgggcttacaagtttcaaatactaagatttgataaagtcacatggattttaaaaaatcactctattgtatgtttgaaacattccataatttaaataaaaggattggtattatatatgtacttgagttgctataatgttttacgttttttctttgcttcacttttgaa

SEQ ID NO: 383660 - DNA, 959 bp, Homo sapiens
taatctaaacttaacattatgatgtccgtcatgtttttataaaaagctccctattctcttttgcagctcaaaattcataaataaacccatatgaataaaaccccactaaaatggaagctttgtttatcttcaaaaatataggcataaggtcaatttccacacactaaacgtcatactgtctacgaagcctttttaatggaaaaagcaactaaaagaccaagtcctctctgataatgatacctccgcaaattagacaaattagtccaaagatttccctttgcttacattttaaagaaacatctgaaatcaatatcaatacgaaatttggtcaattatgtaagggcttagtgtataagagctaatgtttattgagccctgtctctgtaccagacactgttctaagcatttgacacgagttatttcattaatcctcaggacaactgaatgaggcaggtttattcatccattttatggatgaggaaaatgaggcatgcagaattatgtaatacacccagcgtcacatagatagataataggagagctggactccacacactgagccatttaggatttcccctcttgtgtcaagagaacaacagaaggagcctcagaggctattcactactacctcttaaagatcacttttcatgtcctgacctgtaggaagtgcttatacataaagctaaattcttcagactttctactcaccagggccttacagtctagttctccctacgtgacatccttctcttctgcagactacattaccctccctctccccatgttcaatgcacgtagaaatgaatgtcggaacatttgcaagtccctcgagccacaggtcttgaacttaactttgaatttgcctcctcttctcagacccccaaatctagccctgccgctgtgttaaaaggggatctgtcctcttttgtctcagtaagctacttctagcgcgcatcgct

SEQ ID NO: 383661 - DNA, 2180 bp, Homo sapiens
  misc_feature (1375)..(1375): n is a, c, g, or t
atttttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggatcccttcaagacaaagaactcccaaaataaacatgatgctggcaaacctgtacaagaaggctggtcaggagcgcccttcagtcaccagctataaggaggtgctgaggcagtgcccattagcccttgatgccattctaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctgttcactagagaaaaaatccttattgcgagataacgtggacctattgggaagcttggcagatctgtacttcagagctggagacaataaaaactctgtcctcaagtttgaacaggcacagatgttggatccttatctgataaaaggaatggatgtatatggctacctactggcacgagaagggcggctagaggatgttgagaaccttggatgccgccttttcaatatctctgatcagcatgcagaaccgtgggtggtttctggctgtcacagcttctatagcaaacgctactcccgggccctctatttaggagccaaggccattcagctgaacagtaatagtgttcaagctctgctacttaagggagcagcacttaggaacatgggcagagtccaagaagcaataatccactttcgggaggccatacggctcgcaccttgtcgcttagattgttatgaaggtcttatcgaatgttacttagcctccaacagtattcgagaagcaatggtaatggctaacaacgtttacaaaactctgggagcaaatgcacagacccttacccttttagccaccgtttgtcttgaagacccagtgacacaggagaaagccaaaacattattngataaagccctgacccaaaggccagattacattaaggctgtggtgaaaaaagcagaactacttagcagagaacagaaatatgaagatggaattgctttgctgaggaacgcactggctaatcagagtgactgtgtcctgcatcggatcctaggagatttccttgtagctgtcaatgagtatcaggaggcaatggaccagtatagtatagcactaaggtaggcactagcctcccttgggggaaggccactgaggagggtagaggaggcagtgagctgtgtcacaggagttatggaaacacacacacactttgtgtccatggttgaaagcagaataataatagtaatggtagaagagttatttgtgaattcatgacttctaaaaattttttcttaaaatatattaacaacattagagaactgtttcactcataaccatcccacaccactataacatctgtgttcatttgtatagctcatcttctgtccttgcccacacacacatatttttatagggctgtacctagtatatattttatattcttctttttcaaatcaaagtattgtaagtactttcccatgtttctatctactgtagtcattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggtacatagtaaatgctaaataaatagtggtattcttactgttt

SEQ ID NO: 383662 - DNA, 512 bp, Homo sapiens
gtcttatcctcccctggtgtcctctcagctcccagaaccagacctccagactgggagcagataaatatggatcaactgatcgatctaatgatacatctgtcttccactctagtagaagccagtgattcccaaagagggaggtgaggagacagcacccctggtaggaatatatttatctccgggggagagttttcagaccatccccccacctccccacacacaagcacacacacccttacttaagagtctggtgtgctcctctccttttgagaaccactgatgagtgaacacagtgtgtctgaatgatacaaaggcagaaagaagttgcagcacctctcctccagcttggtaggcgcacccttccacatgaccatttccctgacccttaacatgccccagacggaattcatccatctcctcacctagacaaatgacacaccatcgacttcccggacgaatgctgagaacttgccacgctctctccccagggccccatccctatccctgccgcc

SEQ ID NO: 383663 - DNA, 612 bp, Homo sapiens
  misc_feature (8)..(9): n is a, c, g, or t
  misc_feature (15)..(15): n is a, c, g, or t
cattgaanncctttntgtaggaaccgccaattgtgttggatccagggcattcggccattatggaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383664 - DNA, 1647 bp, Homo sapiens
ccgctgcaggaattcggcacgagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383665 - DNA, 1652 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacatagatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383666 - DNA, 1652 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383667 - DNA, 1640 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383668 - DNA, 1645 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383669 - DNA, 1678 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcacatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383670 - DNA, 1613 bp, Homo sapiens
ggccggcacgagctcgtgccgaattcggcacgcggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383671 - DNA, 1653 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383672 - DNA, 1583 bp, Homo sapiens
ccagcttggaagtcatgtttacacacagtgagatggttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383673 - DNA, 1611 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccacccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383674 - DNA, 880 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtaaaggggtttgagcccctaaaatgagggacacaatgtggctaaggccattgggaaccgggatccgggaagg

SEQ ID NO: 383675 - DNA, 1151 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattatcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383676 - DNA, 765 bp, Homo sapiens
atgtatttatttaagcatcaaatatttgtgcaagaatttggaaaaatagaagatgaatcattgattgaatagttataaagatgttatagtaaatttattttattttagatattaaatgatgttttattagataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383677 - DNA, 1003 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383678 - DNA, 530 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagaggcagaggtccctgaaaacagggggatggattcataaactctcctcaaatccaagagaagcacagcaaactagtgatcatgggtc

SEQ ID NO: 383679 - DNA, 800 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattatgcttcttgtaccgctttcttgatggaagagagctctgtctggagccccaaggacaaattggtggttgccgcagggttgtggaagaaagtacccggacacaggggctgactggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaagtcatatcataggaatctacccacaccacccatcattcaacctataggatttccacacatggcggggagatttaccataccaaactgaggccagggcagcccgacca

SEQ ID NO: 383680 - DNA, 559 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtaagcacatctttctgacctacagcgttttcctatgtctaaatgtgatccttagatagcaaagctattcttgatgctttggtaacaaacatcctttttattcagaaacagaatataatcttagcagtcaattaatgttaaattgaagatttagaagcttttataatttataccatgtagcatgcatatatttaacgtaaataagtaatttatagtatgtcctattgagaaccacggttacctatattatgtattaatattgagttgagcaaggtaactcagacaattccactccttgtagtatttcattgacaagcctcagatttgtcatta

SEQ ID NO: 383681 - DNA, 612 bp, Homo sapiens
aaagtcagcctataaatttctttctgttgctaaaaatcgtcattaggtatctgcctttttggttaaaaaaaaaaggaatagcatcaatagtgagtttgttgtactcatgaccagaaagaccatacatagtttgcccaggaaattctgggtttaagcttgtgtcctatactcttagtaaagttctttgtcactcccagtagtgtcctattttagatgataatttctttgatctccctatttatagttgagaatatagagcatttctaacacatgaatgtcaaagactatattgacttttcaagaaccctactttccttcttattaaacatagctcatctttatatttttaattttattttagggctgagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctaca

SEQ ID NO: 383682 - DNA, 1714 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383683 - DNA, 1031 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccacaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383684 - DNA, 758 bp, Homo sapiens
  misc_feature (7)..(7): n is a, c, g, or t
  misc_feature (20)..(20): n is a, c, g, or t
  misc_feature (24)..(24): n is a, c, g, or t
atcgacncccttcgcatgancccntggataggcgagccctctggtggacccggaattcggcctatggccggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaagtgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacatattttttctgtaaatctggaaccctagcctgctgccaggatcacag

SEQ ID NO: 383685 - DNA, 1706 bp, Homo sapiens
tgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgaggccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaacaaacaattgggtacccagttaaattttcatttcagataaacaacaaataattttttagtataagtacattattgtttatctgaaattttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaa

SEQ ID NO: 383686 - DNA, 925 bp, Homo sapiens
taggcagcaggccgcggtcaatcggacgaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383687 - DNA, 828 bp, Homo sapiens
cttgctgcatcgttgggtatgtgttggggaccgcctttccatggcttttgcaggctaggcttggcttatgctggctcaaatcgtgaagatgtcctaacactgctgctgcctgtgatgggagattcaaagtccagcatggaggtgagtagaggctattgagcatttagagtaagtagggaaggtgctttgagtcttactttctgtgataaataatgaaaaagaagtaagtgtgtgcatgtgtgcatacatgtacatgcctgttggtgtgtattgaggggcgtcacctcagtgaaaccccttgatctgggattctaagcctctggtggttttaaggctaaagagttaacattttaggcctggcacggtggctcgtgcctataatcccagcactttgggaggctgcagtgggcggatcacttgagcccaggagttcgagaccaacctgggcaagattgtgaaaccccatttctaccaaaaaataaacagaaaaattagccgggtgtggtgtgctcgcctgtagtgccagctactagggaagctgaggtgggcgcattgcttgaacccagaggtggaggttgcagtgagctgagatcgcgccactgcactcctgtctgggttacagagtgagaccctgtctttaaaagaaaaaaaggggggacattttagtgttgagttctgtcccttggaatctctgagaaactacttggactagagtgaagtgtaacttaacacagcctggggttgatgattctccttagtattgtagtcattggtcagccttaaatgttcatacttgtgcagagtcattaatggataaatacagcatgg

SEQ ID NO: 383688 - DNA, 592 bp, Homo sapiens
  misc_feature (506)..(506): n is a, c, g, or t
  misc_feature (529)..(529): n is a, c, g, or t
cttgctgcatcgttgggtatgtgttggggaccgcctttccatggcttttgcaggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaacggcgaagnacgagaagcggcgaagaaacganaagcggcgaagaacgagaagcggcgaagaacgagaagcggtgaagaaacgagaagcggggaag

SEQ ID NO: 383689 - DNA, 2986 bp, Homo sapiens
ggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383690 - DNA, 746 bp, Homo sapiens
tgaggataggtacgaggcctgggtgttacggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggttttatccccaaggtctctctgtgtctg

SEQ ID NO: 383691 - DNA, 671 bp, Homo sapiens
atcattaaagaccatttccatccagtttcgaaagcccaggggaaagccagtctgtgggaatgttgcggtcgagtatcttaaggactccaacctcctgttcttcggggggctgctggtggccatcgcggtggaacactggaacctgcataaacgcatcgccctccgtgtcctgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383692 - DNA, 2944 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383693 - DNA, 3061 bp, Homo sapiens
  misc_feature (3032)..(3032): n is a, c, g, or t
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaaaaaaaaacgaacacacaacaaccacaaaaaaacaaccaccgccacgacaagaggggggcaaaaagcgtaaaggacacgaacaagcanaacaacaaacaaccgataagatgagacac

SEQ ID NO: 383694 - DNA, 3320 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaaaaaaaaaaaaaaaaaaaaaagggggggggcgccgcaaaaaaaaaccccggggggggcccaaagaaagcggaaaaccccagttttgtgcaaagggggcccccacaatgaggggcggcataatgaaaacgcacaaacacggggagccagccgtaaaaaacggccgcggcgttgcgggcgaaacgcggaccatgcaggggatgctttgtgtgaaacgaacccactcgtcgggtcggggagtaacatgcggggggaaacaacccacacaagaaaatataagccccacgcgacaaacaaaaacagttgacgggtatttgtggtaaccaacgcgctatgcacggcggcgaagtaggccacggactagtactgagaaattac

SEQ ID NO: 383695 - DNA, 3345 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaaaaaaaaaaaaaaaaaaaaaaaaacaaaaaaaaaaaaaaaaaaaaagggggggggcgccgcaaaaaaaaaccccggggggggcccaaagaaagcggaaaaccccagttttgtgcaaagggggcccccacaatgaggggcggcataatgaaaacgcacaaacacggggagccagccgtaaaaaacggccgcggcgttgcgggcgaaacgcggaccatgcaggggatgctttgtgtgaaacgaacccactcgtcgggtcggggagtaacatgcggggggaaacaacccacacaagaaaatataagccccacgcgacaaacaaaaacagttgacgggtatttgtggtaaccaacgcgctatgcacggcggcgaagtaggccacggactagtactgagaaattac

SEQ ID NO: 383696 - DNA, 2984 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaagtatacccgagtaagtgtcatattctgtcctgttttgtgt

SEQ ID NO: 383697 - DNA, 3125 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacaggtaaagaatagaactcctccacagagcgtgccggggaagtatctgtggtgatggaaggaggaacatggagtgttggcccaggaggaaagatgtgaccaagtgggagatttctgtttggctgggttaggcgatgtctcctcagtggtaactcctcacctctacttccctctgtttttttcagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383698 - DNA, 3138 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggtctgtgtctttatgagtctgtcttgtgcttccccagtgactcctcacttctttcttggtccttattttcaggttgtttctcctttctccttcattctgatctgctctagattctttagacttctcctgttttccaaagcttttccttggtaacttctcatttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383699 - DNA, 3176 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcagtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383700 - DNA, 3393 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggtctgtgtctttatgagtctgtcttgtgcttccccagtgactcctcacttctttcttggtccttattttcaggttgtttctcctttctccttcattctgatctgctctagattctttagacttctcctgttttccaaagcttttccttggtaacttctcatttctgtccattctccctcaccaccctgacgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcaggtaatatgggcagctgggcacttgcagagaggctgtgagaagagataagcatataggggaggctgggtttggtttttgctttagggcctctctgggtattgccatgtattgaaatagcgtgtgactgggttctgtatgtaaggggtaaaggtgttccccacaggatggctttttattttcagatgggacttgagtcaagggtgactgttttttattccttgagcttaatgggttctgctctctcttcaattgcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383701 - DNA, 3252 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcagtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcagacgctggattccttgacccacagagaagtgcttcccctgaagctgtgctctcttaatcgtctgggactatctgtaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383702 - DNA, 2254 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtagccttttctttcttttttcttttcttttttgaagcggagttttgctctagag

SEQ ID NO: 383703 - DNA, 2509 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcaggtaatatgggcagctgggcacttgcagagaggctgtgagaagagataagcatataggggaggctgggtttggtttttgctttagggcctctctgggtattgccatgtattgaaatagcgtgtgactgggttctgtatgtaaggggtaaaggtgttccccacaggatggctttttattttcagatgggacttgagtcaagggtgactgttttttattccttgagcttaatgggttctgctctctcttcaattgcagggagtggctgttctggggattgcccttattgctatgggggaggagattggtgcagagatggcattacgaacctttggccacttggtgagtatagcatgaagaaaattggaatatactggttttgatggcctggggttccccagggaagatttttctgatgggttttcttggtggagagctggtctttttgctgtagccttttctttcttttttcttttcttttttgaagcggagttttgctctagag

SEQ ID NO: 383704 - DNA, 2283 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtgagtagaggctattgagcatttagagtaagtagggaaggtgctttgagtcttactttctgtgataaataatgaaaaagaagtaagtgtgtgcatgtgtgcatacatgtacatgcctgttggtgtgtattgaggggcgtcacctcagtgaaaccccttgatctgggattctaagcctctggtggttttaaggctaaagagttaacattttaggcctggcacggtggctcgtgcctataatcccagcactttgggaggctgcagtgggcggatcacttgagcccaggagttcgagaccaacctgggcaagattgtgaaaccccatttctaccaaaaaataaacagaaaaattagccgggtgtggtgtgctcgcctgtagtgccagctactagggaagctgaggtgggcgcattgcttgaacccagaggtggaggttgcagtgagctgagatcgcgccactgcactcctgtctgggttacagagtgagaccctgtctttaaaagaaaaaaaggggggacattttagtgttgagttctgtcccttggaatctctgagaaactacttggactagagtgaagtgtaacttaacacagcctggggttgatgattctccttagtattgtagtcattggtcagccttaaatgttcatacttgtgcagagtcattaatggataaatacagcatgg

SEQ ID NO: 383705 - DNA, 770 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggttttatccccaaggtctctctgtgtctg

SEQ ID NO: 383706 - DNA, 1003 bp, Homo sapiens
  misc_feature (90)..(90): n is a, c, g, or t
ggacgcgtgggtcgacccacgcgtcgcaaacaacctcttcatggtgcgcttggcacagggcctgacacatttagggaagggcacccttancctctgcccctacagcagtctccagcggcggcccccggcggcacggacgagaagccgagcggcaaggagcggcgggatgccggggacaaggacaaagaacaggagctggtgaggcgcgaccccgagagtcggcgaaggaggctgcggggctgagtcacggcggctccgcaggcctcaggcccgacacccaactaccccaccgcgccagggagagggcggttggggcgaccctcgggactcccggcaccttgcctctctgctcctcattctccgttccgcgctgtcacctccgccgtccccaccaaccctcaccaccgccgcgtgaagtggactcgggcagtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagggaaatatgtgtgaaatgttataggaggtagattcagcaggactcctgtttggtttcagtttgatttttggttgtggttgggaggaaggaggaggaattgaggatgttcggggtcactagttagatggtgcggccattcagagcaagagagggaatacaggaagaggaacaaatttgaaggattaagcaatgttataatttcttcaccaatttgtcatcaactgggaaatgttacaccaattattttaactctcttgggaaagaaatgtatgtagtactgaatattgaaaaaagacttgaagtagctggaggagtaatcggaggcctcttgattgggaccgtgattgggac

SEQ ID NO: 383707 - DNA, 423 bp, Homo sapiens
cagcgctgaggtgggctctcaatgtttctggccaggcctgtctttttgtctcttaactttttgtcctgtctgcttccctcagttattctaggcaaatcacactatgtattgtatgggctggtggctgccatgcagccccgaatgctggttacgtttgatgaggagctgcggccattgccagtgtctgtccgtgtgggccaggtgagaggctgagtagaggggagggctcaggctgtattctcaaactggagaatgtacatatacttgctttgctgaaactggcgtgggcggtggcttgtcgctacttttccatctctcttttcaattttcttaccctacaggcagtggatgtggtgggccaggctggcaagccgaagactatcacagggttccagacgcatacaaccccagtgttgttggccc

SEQ ID NO: 383708 - DNA, 299 bp, Homo sapiens
tgacatcatctccgttttggccatgaccatgagtggggagcgtgagtgcctcaagtatcggctagtgggctcccaggaggaattggcatcatggggtcatgagtatgtcaggtaagatctttcttcttgggaatccgaagggggctctgaggctctgagataattcagaattttcttgtggagtacaatctgtcttggagcatcagtgtattgaatttcccagacgctggattccttgacccacagagaagtgcttcccctgaagctgtgctctcttaatcgtctgggactatctgtag

SEQ ID NO: 383709 - DNA, 647 bp, Homo sapiens
ggacgcgtgggtcgacccacgcgtcgcaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383710 - DNA, 926 bp, Homo sapiens
  misc_feature (827)..(827): n is a, c, g, or t
  misc_feature (894)..(894): n is a, c, g, or t
  misc_feature (915)..(915): n is a, c, g, or t
ggaggaggaggggcgccgcgaccgacgcgcgcgagttggtctgggaaaaagggcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttacgtgcctgagctgagaatcanctatgggtgtgcctgggtgtgtccaagttaccgttcctgacttggatgcttgtctatgctgattgtnaaaatttactctgaagttgancgacgtgatct

SEQ ID NO: 383711 - DNA, 267 bp, Homo sapiens
tgctggcggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcaccaccaatacagtgagcaccaccaataca

SEQ ID NO: 383712 - DNA, 326 bp, Homo sapiens
cgagctcggtaccctgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagaaatttgagaggcttgggcactgaagtcatggaagttgtagaagaacgaatctgccttcgcaattcctccagcgctggtcgatacagggatgtatcctcgtggggtagaggt

SEQ ID NO: 383713 - DNA, 2950 bp, Homo sapiens
  misc_feature (90)..(90): n is a, c, g, or t
ggacgcgtgggtcgacccacgcgtcgcaaacaacctcttcatggtgcgcttggcacagggcctgacacatttagggaagggcacccttancctctgcccctacagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383714 - DNA, 3214 bp, Homo sapiens
  misc_feature (3065)..(3065): n is a, c, g, or t
  misc_feature (3129)..(3129): n is a, c, g, or t
  misc_feature (3185)..(3185): n is a, c, g, or t
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaaaaaaaaaaaaaaaaaaaaaaaaacccgcggggggcacctaattgcgggtggtcgacaacaagggttctgcagcggccttggtctaaggctgtttcctcgaaccggttcttgtaccagggnaaacggcgggcccctaaggagcggttaattcgaaagccgtaacgtagtttctcgcacacaactnaaagcaggacacacgagaggcgataacgagctcgaacgcagaacacgaacaagcanaacaacaaacaaccgataagatgagacac

SEQ ID NO: 383715 - DNA, 3371 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaaaaaaaaaacggaacggagagagagaacagaagcggaaaggagcaagagcgacgtgagaggaggaggaaggagagaggtgacaggtcgacgaacgacgaacgcaggaagagaaaacagatgcggagggcgtgggcggcgagaagagagcgagacacacaacaaaagcggaggggcgcggcgcaagcaggagtacgaacagggcgagcaaccagagcgaccacgaagacagcacccgaggaagagaaagaggagagaggagaggaagacacacacacagacacaccaagcagccgcgggagacaagccgagagcccaaagaacaagagacagacgagaggtgagtggacgagaggacgacaagccgggagacgagacaacaaaggggagcagacgccagcaccaggcacaccaacaaaaacagcgccg

SEQ ID NO: 383716 - DNA, 2973 bp, Homo sapiens
  misc_feature (2973)..(2973): n is a, c, g, or t
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaataactatcatgccctgcgcgtgcggccgn

SEQ ID NO: 383717 - DNA, 2987 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaaagatgcggccgaaccacaccactcctactcatcaccgccattg

SEQ ID NO: 383718 - DNA, 3032 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtgagtatccggcagaagaaggtcataaacagattgggggaagatttgaagccccttttttcacttctgtaatgcttaacatttccaggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383719 - DNA, 3120 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggtataattctgttcctgctttgtcttttgttttgctttgatcacttcttttgtcctcttggagtcataagttatctgacaagggatccaccatgcagttctttggagagctctttataataacaggatcctcaggatagggccattttaagactaatagattcttccctggtataggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383720 - DNA, 3084 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggtgagaggctgagtagaggggagggctcaggctgtattctcaaactggagaatgtacatatacttgctttgctgaaactggcgtgggcggtggcttgtcgctacttttccatctctcttttcaattttcttaccctacaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383721 - DNA, 2587 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgcagctgatgttatcagcaggccatgcatcctgctgccaagggtggacacggctgcagacttctgggggaattgtcgcctcctgctcttttgttactgagtgagataaggttgttcaataaagacttttatccccaa

SEQ ID NO: 383722 - DNA, 2734 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatggtgggcagtggtaccaataatgcccgtctggctgcaatgctgcgccagttagctcaatatcatgccaaggacccaaacaacctcttcatggtgcgcttggcacaggtaaagaatagaactcctccacagagcgtgccggggaagtatctgtggtgatggaaggaggaacatggagtgttggcccaggaggaaagatgtgaccaagtgggagatttctgtttggctgggattacaggtgtaagccactgtgccctgcctgtggtgtcttgggaaactcatgagtactatgtgtctgttgtaatagagggaaataagtggtttttcacagtgatttgtagtggactgtgaaattttagggattcaggtcagagttgtcacacaggttgtagtcagggtgagaactgggtcatgatgcagtatgaaaaagtttgagagccactttggagagaacttgagataggccacctaccagtgtgggaaccag

SEQ ID NO: 383723 - DNA, 2215 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcaggagtggtgttctgggggatgccttatgctatggggggcggacaattggtgcagatggcttacgaacttttggcacttgctgagattgggggcctacactccgggggtggtctttaatggctcattctgtttaatcccatcatcctggtacttagcattttctgtgtgtccaaatcctccaccctttccggggggggggggcgccaacc

SEQ ID NO: 383724 - DNA, 1995 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaacagtcgaggtatgacagaagtccagaatgccgggccaggtata

SEQ ID NO: 383725 - DNA, 1660 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcagtgtcacagctttagcctgtggaatgatacagcaccacgattcgccgaagatcctgat

SEQ ID NO: 383726 - DNA, 1471 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaaggttggtctgcatacagcctgctcatggggacttccccgttccatattctagtgcctagcagtgcctctctttcactgatgaggtctgccca

SEQ ID NO: 383727 - DNA, 884 bp, Homo sapiens
  misc_feature (785)..(785): n is a, c, g, or t
  misc_feature (852)..(852): n is a, c, g, or t
  misc_feature (873)..(873): n is a, c, g, or t
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttacgtgcctgagctgagaatcanctatgggtgtgcctgggtgtgtccaagttaccgttcctgacttggatgcttgtctatgctgattgtnaaaatttactctgaagttgancgacgtgatct

SEQ ID NO: 383728 - DNA, 1435 bp, Homo sapiens
gggggggacccaaacatgcaggtcgaggctggtttcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcagttgtgtgaattacgtgcctgagcctgagaactcagccctactgcgttgtgccctgggtgtgttccgaaagtttagccgcttccctgaagctctgagattggcattgatgctcaatgacatggagttggtagaagacatcttcacctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcagtgtcacagctttagcctgtggaatgatacagcaccacgattcgccgaagatcctgat

SEQ ID NO: 383729 - DNA, 385 bp, Homo sapiens
gatctggcaaccaattatgtaaatagtcatatgaatccttcagaatggataacacagcttttctgactggtgtgaaatagttttcaggtgctcattctttacttcattagcttatcttatatcattagcttatcctccattcaggtataacagatcttttttttctgataaatatggcagtttagggaaataaactatggcataatatgctaggccattcttctaggccacgcttcttgattgtaaccttaaaccctttatcagaacctaaacaacttttcaaaagatctatacatatttttatccaatgtttaaggctatgagtaattcattatgtcactcttcatttttttcacctgataatgatctcgacaaaaatgttgag

SEQ ID NO: 383730 - DNA, 399 bp, Homo sapiens
gagagattaagaaacttctattattttaatagttagcagagttcggatttaaactcaatcctgttagacttcaaagccatatttgtaaccattttactatgccgatttgttctgtctggcctacaaataagaatgtatttgtttgtttaatacttatttgttggatatctactatgtgataaaaaaacaacgcatatataaccacaggcaaggttccaattaagaaataaatcttaggaggggcctgtggtgaaatacaatgtgaccaaatctttatatatcttttcaagtgtataaactgcagatggttacagacataaatattggtaacttcatataccagtttcagttagccaagtctgttgaagaatttcaccaaattattattattattattat

SEQ ID NO: 383731 - DNA, 1131 bp, Homo sapiens
tttttctcaatcaactttttattaatattcataacatttatgcaacatgaagattctgaagggtctttgttgtctgagaacacatctatttcagatctgcggagtgtatcactttttgctgtgtcttcaaagtgactcttggtttattgcctgctaaggctaataaatgtataataaatctgcttgttgtgtcacttgcaggtgctatggtctttagaattgggtcactggatttctgaggagccgttcgaactgtctcaccacttccctgcagctcccgtaagtcagatgttgttttacgatggtaaatgcagtttgctgttctcaagaaattattataaacataagggtggacttaagtttttatccagtcaagcacaattatgcccataattaaaaagacattcacagaacttaacaccttttatcaatttattcgcgagaacaaatgtgagaacgtgagaccattgtgcaaaaagtagtgaggaatgcagtccaaagaaaatttgacgattaacatcctcagaactgagaaaaacaaaaatgaaaaaagactgaattcttgggcaggtagtcttatatcttgcttaatgtttttactgttaatagaaatagaactgataggtataaagattatggcttgctggtgctgtgataacagtatttatatttttatggctttcctaaattccacttcaactttcaaatgcttcattgaaaagttctgggttctaattttttttaagattaagtaataattaagtggataatttaaagtttgcttggatacaggattgtgcagaagttgcctttcctgttcaaaaatgttaatttgtttgtcacagtttattcattcaaaagattaatagctgaaagataaatggtgatttttatctgccactggtgttgttatttagctgtttgagtaggccatatgactaaaacataacaaggagttgaactgtgctccctgatcactgtagttatctaggttgttgggttgttttgttttcatttttaagattactgtttgatttcctttcagctttataaacattttcttaaggagagacaaaagctcctctcagcaaaactgtttgtttgaaataccgtgtaaggaattgaagtgta

SEQ ID NO: 383732 - DNA, 674 bp, Homo sapiens
attgttttattactgagaacaactagagaactctgcaagtttcttggcttagactcgatctttattaatacattatctattaggtaggaaagacatttgtcagctattaaggtgacttttatctagcggagattcctctcttaaagtaatgaaaggagataggtatggggggtgttatacaggataattggtgacatctgagtgtcttacttctgcaagcctgctttatggtgagcaaagcatcaccagcaagtgatcacaatgtccactggccgctttttgcctgccgtcctcgagatgaaattggcagttggggctgattcacagaaacaccgatttgtggctgagcacggtggctcacacctgtcatcccagccctttgggaggctgaggtggacagatcacttgaggtcaggagttcgagaccagcctgaccaacgcagcaaaacccatctctactaaaaatacaaaaatcagctgggtgtggtggcacacacctgtggtcccagctcctcaggagtctgaggcagaagaatcgcttgaacccaagaggcagaggttgcagtgagccaaggttgcagtgaatcaagattgctccactgcacgtccagcctgggcaacagagtaactctccttctcaaataaataaataaataaataagaaacaaaaaagt

SEQ ID NO: 383733 - DNA, 2891 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtccagcctgggcaacagagtaactctccttctcaaataaataaataaataaataagaaacaaaaaagt

SEQ ID NO: 383734 - DNA, 3139 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccgtaagtcagatgttgttttacgatggtaaatgcagtttgctgttctcaagaaattattataaacataagggtggacttaagtttttatccagtcaagcacaattatgcccataattaaaaagacattcacagaacttaacaccttttatcaatttattcgcgagaacaaatgtgagaacgtgagaccattgtgcaaaaagtagtgaggaatgcagtccaaagaaaatttgacgattaacatcctcagaactgagaaaaacaaaaatgaaaaaagactgaattcttgggcaggtagtcttatatcttgcttaatgtttttactgttaatagaaatagaactgataggtataaagattatggcttgctggtgctgtgataacagtatttatatttttatggctttcctaaattccacttcaactttcaaatgcttcattgaaaagttctgggttctaattttttttaagattaagtaataattaagtggataatttaaagtttgcttggatacaggattgtgcagaagttgcctttcctgttcaaaaatgttaatttgtttgtcacagtttattcattcaaaagattaatagctgaaagataaatggtgatttttatctgccactggtgttgttatttagctgtttgagtaggccatatgactaaaacataacaaggagttgaactgtgctccctgatcactgtagttatctaggttgttgggttgttttgttttcatttttaagattactgtttgatttcctttcagctttataaacattttcttaaggagagacaaaagctcctctcagcaaaactgtttgtttgaaataccgtgtaaggaattgaagtgta

SEQ ID NO: 383735 - DNA, 3315 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagactggcaagcttcccaccctgcccactgagtgtcctgacacaacgggaacgtgccctgcatctaatgggacatgtggctaccaagcacttgaactggccagtgtgactgagaactgaatgtttcattgtattgaatttcgtttcacgttaatttaaaaagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaa

SEQ ID NO: 383736 - DNA, 2539 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggttgcagtgagccaaggttgcagtgaatcaagattgctccactgcacgtccagcctgggcaacagagtaactctccttctcaaataaataaataaataaataagaaacaaaaaagt

SEQ ID NO: 383737 - DNA, 483 bp, Homo sapiens
acttcaatttctttacgtcccttctacctctgaattatctgttttatggcctgtttactattaaatgatccatttaatagcatttacccttagctttatgagtaccatgcactaataattttgaagtatgctacaagtcaaaaattgttgtgtaaaaattgtacttcctttacctgcctcttgcttctgttatacttaaataccagatagagatgattttgggaagtttgatttatactgacttttgtatttgctgttgtatttattttttaaaagtctgttaaaatgacctagctatggatttcttaaattgctaatacatgtgcagatttagtgctgtgtcaatgtataatagaagcaaatactcattagactaccttaatttaattatacagatgcaggacagctggagcacacattgatgaatcattgttccctgcagctaatatgaatgaacacttatcaagcctaattaaaaaaaaa

SEQ ID NO: 383738 - DNA, 3079 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgtaaagatgtatacgatagagagtattttaaaacctaggttcttaatagtgaggctatttaaagaaagaaattaaggtagattaagccatcgattgtatcaaagagaaagtgtgaaaaactacttttagaaatctgttgtcaatattgatttttgaagaaactttggtcagtgttaactatgaagaaacatttaaacatttttgctcatttgtaacaagccttgtttaacttgtacttattttgcttgaagcatcacttgaaaaggtttactcctattcataatttaattgtaattataataaaccatatcattttattaaaagtcaaaacaataaaaaattttgcacttcacagttataagcacaaataggttccagcaaccaaaattgaagaaatcttgaactttgaccgtctttacctaaagattaggttaaaatttgagtgagaacgcattctctctgcatgatttctctgctctacaaatgttttaactgcctctttgaaggtggagaagtcatggtagcgtttgaaatcatcacagacatgttacataccttttccttgagtatacgctccccaaaattgtttcacaaaaagaatgaaaataattttatgtttttggcctgctatttatatcttggctttctgaacatatattaaatttgacaagaaactgtattttatgttccattagccttagtatgtgttttcaaaatatttattttaaaatgttgactcaaaagttaatataaaacaatagatgtgtaaaattctgtggtagttaagaatatcctgttctgaggtttacattctccatctttccagttttcaccttgtgt

SEQ ID NO: 383739 - DNA, 3155 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaagccaacaagaacattagtcatgacaagcatgccatctgaaaagcagaatgtcgtcatccaggttgtggataaattgaaaggcttttcaattgcaccagacgtctgtgagaccacgactcacgtgctttccgggaagccacttcgcaccctgaatgtgctgctgggaattgcgcgtggctgctgggttctctcttatgattgggtgctatggtctttagaattgggtcactggatttctgaggagccgttcgaactgtctcaccacttccctgcagctcccctgtgccgaagcgagtgccacttgtctgcagggccgtaccgcggaaccctctttgccgaccagccagcgatgtttgtctcgcctgccagcagccccccagtggccaagctctgtgaactagtccacctgtgcggaggccgggtcagccaagtcccccgccaggccagcatcgtcatcgggccctacagcggaaagaagaaagccacagtcaagtatctgtctgagaaatgggtcttagattccatcacccagcacaaggtctgtgcccctgaaaactacctattgtcacaatgacagtgacctcactggcctgtggtgactgcacacagctcgcaaaactgtctttggatgttcaaatgagaaacaaaactgtgaagagaaggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaa

SEQ ID NO: 383740 - DNA, 2036 bp, Homo sapiens
agcggagtgcccgcccgcgccgccaggctcgcaagcaccgcgtaggccagctggccggatcccgccgtctgtcatggcggcccccatcctgaaagatgtagtggcctatgttgaagtgtggtcatccaatggaacagaaaattattcaaagacatttacaacacagcttgtggatatgggggcaaaggtttcaaaaacttttaacaaacaagtaactcacgttatcttcaaagatggctaccagagcacttgggacaaagctcagaagagaggcgtaaagctcgtttcggtgctctgggttgaaaaatgcaggacagctggagcacacattgatgaatcattgttccctgcagctaatatgaatgaacacttatcaagcctaattaaaaaaaaacgtaaatgtatgcagcccaaagattttaattttaaaacaccagaaaatgataagagatttcagaagaaatttgagaaaatggctaaagagctacaaaggcaaaaaacaaatctagatgatgatgtacctattctcttatttgaatctaatggttcattaatatatactcccacaattgaaattaatagtagtcaccacagcgcaatggagaagagattacaagagatgaaggagaaaagggaaaatctttcccccacctcttcccaaatgattcagcagtctcatgataatccaagtaactctctgtgtgaagcacctttgaacatttcacgtgatactttgtgttcagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctcaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaaggcaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtgttaaaaatagaccaacaaggcatgatgttttagatgactcatgtgacggctttaaggacctcatcaaacctcatgaggaattgaagaaaagtgggagaggcaaaaaggtcagtgtgtaaaaatattattttaaac

SEQ ID NO: 383741 - DNA, 472 bp, Homo sapiens
acaaatttaccccagtttgacttctgctgctaagactccagcttgcagagctctgccaggcctgagccccagcacgttgtgagatgctttatatagaagagcactgatgacccaaacagattaaagacaaggctttacaaccattatctgcttcaatgttcatcacctctacgtggaagttaccatcatcacacgagagatggtgggtgaagccaaggcttaaggtttttaaactccaactaggcttcaaacggagcactgattagccagaacttttgtaacttccatacacagtttcctgagtagtttcaaaggatattgatacagctcgtcctgagaagtgttcagaagtgcagatcgtcagccccacaagggtaatcacggtttgttttgttcactgatgcaaaccaagaatctgcagcagaggcgcataatcatcacacaataaatgcttgttgaatgaatgaatgaa

SEQ ID NO: 383742 - DNA, 309 bp, Homo sapiens
ctaattatcatctatctacatcacagagttcagggaaatcacagagcagactaagaacaatactacatatgggtgccttactttgcaataagctggctctaagaaaagtggtgtggcattcatctgtacaaacagttgtcttttccctgccattaagggaggaaggtgttgaattcatgatggtaatggacattctttaacctaccaagaaagttagggcatgctattttatcatatggagccataatctcccaatagtttaaataaggaggtgaacagataattactaaggttctcttagattctaaa

SEQ ID NO: 383743 - DNA, 337 bp, Homo sapiens
agaatagatttacaatataaagcagctggtgctataaaatacaaaatttaattaatttacctctggaaatttagaaataaaaaagagcaaaaattaataaggaaacataatagcataagagaatgaatgctattcatagtggtatgctaagaaatttgaaaatcttaattgtaactttctagaaaaatataaatttcaactttagataatttttttcaaaatacagaagaacattaaagttaaaaatttatttaataaaattagcattatcttgacaaagatgtcaccaaaaaagtcttagaataatcttatatatgtacacagatgaaaaaagaaa

SEQ ID NO: 383744 - DNA, 397 bp, Homo sapiens
atttaatatcttacattacattaatagattcttaatactaaaacaattatacttatatattgaatctgaatactgaaccttaatactttcaattttacaattaattctgttctgttatgggtttttttgtttttgttttttttgtgagatgcagtcttgctctgtcacccaggctggagggtaagagtgcattggcacgatctcggcttaactgcaacctctgcctcccaggttcaagtgattctcccacctcagcctcttgagtagctgggattacaggcgtgcaccactgcaggcagataattttattttttatttttagtatagacagggtttcaccatgttggccaggctggtctggaactcctgacctcaagtgagccaccagccttggcct

SEQ ID NO: 383745 - DNA, 406 bp, Homo sapiens
aaaggcaaaactatggagacaggaaaaagatcagtggttgccaggggttagtggggaggaaggggtgataggtggaacacagaggatgtttaggacagtgaaagtattcctgtattaaactttaatggtgaatacatgtcattatacatttgtcaaaactcatagaacatacatcaagagggaagcctaatgtaaactatgaactttgggggataatgatacatcagtgttggttcactgtaacaatgaatcactctaacaggggatgttgatagtgagggagcttatgtgtatgtagggggaaggggatacatgtgaaatctatactttctgctcaattttgctgtgaaccccaaattgttctagaaataaattgtattaaaaaaatcaatgccattgaatgagg

SEQ ID NO: 383746 - DNA, 175 bp, Homo sapiens
gcgtgccggaatttaagtcatgggggagagtctgaggctgaattagtaatgagttcagagaaagctaagcaagaagaaaagcaaaggcgattattaacttcagggaaacagctcagagttcgggtgagaacaggcggccacggtggacctggcaccaagctagtccccggcgccc

SEQ ID NO: 383747 - DNA, 370 bp, Homo sapiens
cagaaagctcctttaattaccacaacctatcaattaaataagattataaattacatttaattgctgttctaaaatgtagttgaaaaattcatttgtaccctatttgaatgcctggattatctatcacctcactgctctcatctaaatgcaactgcttaacccatcttacagtttttaaatgcaatgagttatccacaaaaaagacagaattaaaaaaataaaatctacaatctccttttattctttggccctatgctaaccatagaaaatgtacacattccctatatctgcttcctccaccccttaatacattaaggactcttacatattaaagttgcataagattttaataaaagcatttgagacttcc

SEQ ID NO: 383748 - DNA, 639 bp, Homo sapiens
gcggcacgagggtgtcagtcaagaggcaacactaggaggcaaggaatctgcatttctttcagaccttggcagagagcgccctgggaaatgcggatatagaaggtcaggagaacatctctcctggttatacagcattccaggactcctcatctgtttttaagagggaaatctgagttttcaaggaaagccgaatacagttgccaagttgccagtcaaagaaacaatgtcaacacctgctcatagagatggaattcctaacccggaatattgcccttgaattacaacgagaaaaagaacacttcttattcctgtagcacctcttcaagtgagatggcagaccacctcaggatggaaatgtatttcttcatccccctctctacttccctgtgacctcctgcaaataagggagagacaaagagaagagcagaagaacagaagaatggagtggcaaagagaagagaaggagtgactgaacattgacaagactttggttggggatggtcagagaggagattagctgctagacggccacactgcggagaaagatcattttcccactccatcccccttccagctccccatccatctcaccaagagccagctccaccactcaataaaaccttacattcatctttcaag

SEQ ID NO: 383749 - DNA, 634 bp, Homo sapiens
tttcatgtggttgaggataatatcattagcaccaaaggtgaaaatccgtggaagctcatcttatttcagcagaagagtaggatgggccttgtggcacgagtaagccaaacaagggaaaggcattcaccatcaattgactcctcatctgtttttaagagggaaatctgagttttcaaggaaagccgaatacagttgccaagttgccagtcaaagaaacaatgtcaacacctgctcatagagatggaattcctaacccggaatattgcccttgaattacaacgagaaaaagaacacttcttattcctgtagcacctcttcaagtgagatggcagaccacctcaggatggaaatgtatttcttcatccccctctctacttccctgtgacctcctgcaaataagggagagacaaagagaagagcagaagaacagaagaatggagtggcaaagagaagagaaggagtgactgaacattgacaagactttggttggggatggtcagagaggagattagctgctagacggccacactgcggagaaagatcattttcccactccatcccccttccagctccccatccatctcaccaagagccagctccaccactcaataaaaccttacattcatctttcaag

SEQ ID NO: 383750 - DNA, 614 bp, Homo sapiens
tttcatgtggttgaggataatatcattagcaccaaaggtgaaaatccgtggaagctcatcttatttcagcagaagagtaggatgggccttgtggcacgagtaagccaaacaagggaaaggcattcaccatcaattgactcctcatctgtttttaagagggaaatctgagttttcaaggaaagccgaatacagttgccaagttgccagtcaaagaaacaatgtcaacacctgctcatagagatggaattcctaacccggaatattgcccttgaattacaacgagaaaaagcacctcttcaagtgagatggcagaccacctcaggatggaaatgtatttcttcatccccctctctacttccctgtgacctcctgcaaataagggagagacaaagagaagagcagaagaacagaagaatggagtggcaaagagaagagaaggagtgactgaacattgacaagactttggttggggatggtcagagaggagattagctgctagacggccacactgcggagaaagatcattttcccactccatcccccttccagctccccatccatctcaccaagagccagctccaccactcaataaaaccttacattcatctttcaag

SEQ ID NO: 383751 - DNA, 619 bp, Homo sapiens
gcggcacgagggtgtcagtcaagaggcaacactaggaggcaaggaatctgcatttctttcagaccttggcagagagcgccctgggaaatgcggatatagaaggtcaggagaacatctctcctggttatacagcattccaggactcctcatctgtttttaagagggaaatctgagttttcaaggaaagccgaatacagttgccaagttgccagtcaaagaaacaatgtcaacacctgctcatagagatggaattcctaacccggaatattgcccttgaattacaacgagaaaaagaacacttcttattcctgtagcacctcttcaagtgagatggcagaccacctcaggatggaaatgtatttcttcatccccctctctacttccctgtgacctcctgcaaataagggagagacaaagagaagagcagaagaacagaagaatggagtggcaaagagaagagaaggagtgactgaacattgacaagactttggttggggatggtcagagaggagattagctgctagacggccacactgcggagaaagatcattttcccactccatcccccttccagctccccatccatctcgtctcttctcttgtacatctcgtctcttct

SEQ ID NO: 383752 - DNA, 347 bp, Homo sapiens
atttttttttgtatttttagtggagacaggatttcactatgttggccaggctggtctcaagactcctgacgttgtgatccacctgcctcggcctcccaaagtgctgggattacagatgtgagctaccgtgcccggccaggaattttttgtgctataaatcatattttccttttattaaaggcagtgtcaatatctatagtataattttgaggaggctggctatttattgctgtgtagaagctggcttattagtggtcaaggggtcatctagaattgactataaagatagtattgagcagaaaattcttaaaatacctgcatatttgtttcagtcattaaattaatgg

SEQ ID NO: 383753 - DNA, 1618 bp, Homo sapiens
ccggtccccatcctcagggcctcgagcccctctgcgccaggtcacactccacggctgggcccttcctgccctggctctgcaccactgcccaggctgtgcctcctgctacatgcccttcctttccccctcctcgggtgctgcgatttcctggaagcttcctctgccagtgccccaacctggagagaatgtgtcacattgcccccctctgcagccatgttctgggagggaggtctgcatcttgtcccaggtctggtgccaggacaaagcagcactcctgggaaatggcatttcccctgggtgcacaaaactgtagggaccatagcctaggttccggggactgctggctcactcactcccacactcgctgcccacagacactcctcgctggtggcatcgtggaactctgtgccttaaacgcccgctctggtccctctactcaagctgctggctcacacagggtgttccggcgcctggggagtgtgtcagtgcccttagcgccacccacacccctctgtgagggggctccctcacacccctggctcctctgaagctccatgcccacgtcacacagactttcttttgcatttggcacaaatcaccaagtgaggttgcaggtcacaggtgcacaccttcccactgggtgtacacggtggaactgaagccccaggcgtccctggaggggcccgagggagatgataagcagtccccaggacagctgagtggccccatcccacctgcatcttagggggctggtggtgctgacgggctcatcatgagtcctgtggtccttgcctggcccacactggagctggcttccagcttcccacgtctgcccagtgatgtttcatccacagataggcccagcccccatttgctagggtggtgcccagacccgaacccctgggctagttgggatctccagaggaggcatctgcctggagggtggcttccagtgtgtcccacccactgcccccacgcctaccagctggtgccctctcctccacctggggcttatccttccggccaccctctgtgaccctggtcttcccctccctaccttggatacaactgtgggcagcccacctgagctcccaagagctgggcagtggcacagacacagagactaccagcgaggcagggatgtggccccagaaggtcctgagcttgcaaaggattgttctggctgtctcagccagctcttgctgttccacctgccccagaacctccgcatcagttgagggtcgtggggttggaatgtgtggcgaagtaggtctgtggcagtggagttgggccatgctgagcctgtgactgcccaggagagaattggaaactaaaaggtgcaaaagcagtcagagactccctaccaccccctcactgtgaacattggcccagcggcctctggggcagtcgctgtaaccatccgcgtggcaccctcggttctcagaggctgagacctccgtggctggagatgcttattttctgctcagttgttgttctgtagaacttatttctgtctacatcctgcctcatccctgagcctgccccacctggtccacattgcctttttttttttgataaagttttattgagatatgactgactagcggcacagttcacc

SEQ ID NO: 383754 - DNA, 488 bp, Homo sapiens
actctgtctcaaaaaaaaaaaaaaaaaaaaaaagtggcagaaataacactgtgtgagttctagtagctaggcgttaaaaggtctcagctttgcctttgctctcctggacagtggccctgaccccatacataaagaagccagttcagccgactggaggatgagagtccatgagtagaatctgagcagccccagcactgattccagacatgtggatggggccatcttagatcttccaatctaaccacgagctcccatgagtgagccgaaggagcccagcagcagagccaccatgccaacctacacaaaaaagtaacgaactgcggtggttttaagccactacatttttaaatcacttgttatatagcaaatgctaactgaaaaagaaatcaagcttgccttagtgaccagctctcacagaagacactttgtgcccctattttaatcatcacacttggatgtaagacactttgagccaattccaaaaaccc

SEQ ID NO: 383755 - DNA, 532 bp, Homo sapiens
gggagaccaagactggcggatcacttgaggtcaggagttcgagaccagcccggccaacatgatgaaaacccatctctactaaaaatacaaaaattagccaggcgtggtggtggtgtctgtagttccagctactcaggaggttgaggcaggagaatcacttgaacctgtgaggtgggggtggaatgagtccagatcgtgctactgcactccagcctgggtgacaaagcgagactctgtctcaggaaaaaaaaagaaccaaaaccatatatatggctatctcatcaatcagaaccacaacaactataaaacaactatatttaaggttttttgcaaaaaaaaaagttaaagaaaatattaagtaaataatagatcatttgcttcaagatttggcaaatgtaaggataggaaacgctgttctatgttatcctgcttggccttttttccaacttctcagaggcgttctgccttcaaactccctcttgaggaaaataaacacccacaaagatttttgcatcatctgcaaatatgattc

SEQ ID NO: 383756 - DNA, 130 bp, Homo sapiens
cagggccagggcactggaagggatggctagggccaccggaggtcgtccctgagctctggggttgtgtttgttcccaggtgtgctctccagggtccaggaggactcgtgggagctcgaggctggggtccca

SEQ ID NO: 383757 - DNA, 555 bp, Homo sapiens
aaggttgaggatgggtacccatgacacagtctcaggaggtcatgacaacatgtgcccaaggtggttggggcacagcttgtttttatgcattttagggagacatgagacatcaatcaatatatgtaagatgtacactggttctgtctggtgaggtgggacaattcaagcaaggagggggcttccaggtcacatgtaggtgaaagacaaatgatggcattcctttgagtttctgattagcctttccaaaggaggcaatcagataccccattatctcagtgagcagagggatgactttggatggaatgggaggcaggtttgccctaaacagttccctgcttgacttttccctttagcttagtgattttggggccccaagattcattttcctttcacaagtaactggccacaagagaaacagaaacaggattaagaaagagccctaacccctcccatcacaggctccatcagcacattagagaggagtacactaggtgactatatatacatatttgtgcctgtgataattgcaaataaaatgacactaaccattgtaaa

SEQ ID NO: 383758 - DNA, 323 bp, Homo sapiens
agagcaagactccatctcaaaaacagagttctgagaacaaagggccatgaattgcaggacgaaatatggaaaacagaattggagaatcccagagctccaaggacacttagaaatcatctaacagtaccccaccccaggcatctacatacgcggtaccggtagagaaagcctgattttggagtctgtcctggacacacttggtgttttatgtatttcatcaaatcctcatacccatcctgtgaggtgtcattattaccatttcactgatgagacatccaagcatcaacaaaaccctgaagtggaaagaggggtaaggactcatt

SEQ ID NO: 383759 - DNA, 287 bp, Homo sapiens
gacacagagaagttggcagtctgcaacctggaagaggccctcatcagaacctgcccatgcatgaaacaccccgatcttgaacttctaccctccagaactgcctgccagaatgaaaataaagaacaaagacaacaaagaaaacagccgacaggaacaggatcttgggagccaaatatcagggtctcactctgtcaccctggctagagtgcagtggtgcaatctcaactcactgcagtgtcaaccttctgggctcgagtgatcctcccacctcagcctcctgagtaact

SEQ ID NO: 383760 - DNA, 446 bp, Homo sapiens
ttttggagatggagtcttgctctgttgcccaggctggagttcaatggcacaaactcggctcactgcaacctccgcctcccaggttcaagcaattttcctgcctcagcctcccgagtagctggaattacaggcacacgccaccatgcccagctaatttttgtattttagtagagacgggggtttcaccatgttggccaggctggtctcaaactcctgaactcaggtgatccactccctcggcctcccaaagggttgggattgcaggcgtgagccaccacgcccagccatgatccttaaacttgttttaagaggtataataactggaaatcatgatgctctttaaggaataccaattggatgtattattgatgtatttaattccatcatatgaagtagaaacagtttcattagcagaaggcattatattatagctacacaatataaag

SEQ ID NO: 383761 - DNA, 207 bp, Homo sapiens
cttaagtgtggaaatacagaagcaaaggaaaaaacctcaataaaatcatattgtgaacaaactgcttcccagtcactgcacacaaatgctgccaaacacttcagaatcaaagccagacacaatggtcaaaaatataagccatattctagcttcaggtagaaataaatctcttcagggaaagaagctacaatgagaactaaagggagg

SEQ ID NO: 383762 - DNA, 606 bp, Homo sapiens
tatgttaaaattataactcaatcaccagtctttataaatttgcttttttatatttaaaccaaacctaatgctaattgtgatatgttatttattctcacctgatttgaatcattggattcaattaaatgagtaattatcattaaataattctaagagaaataatgtctattcggatggtgggaattttcttcctacatgcagccccattctgaatgaatgaaatcaaatcacgtgaagatcagggtcctagagtaacttaatattttgtacattggttatttgactcctcatttttatattacatgttatatcaagggagggggtataaaagaaatacaaaaattgcagaggtatctggaatgtacctatttgttaattctatttgtcatttcttttgtttcatcttttgagtaataagctgcttggaaaagtttctgttctttagctgattttttagctataaaaatgtatttgaaaagctcataaatttcaggattgaaaagataattgaaagttttaaagaaacctaattcattgaagtaataaacaaataattttcaatcttgattcaactgtgattcaaatcttacaccatttgcccacttc

SEQ ID NO: 383763 - DNA, 388 bp, Homo sapiens
ctgattgtctaaagacttcttgctcccactggtgcctggactcccactgcatgtccatgatgctgcgtgcccatgacagtggttgctgaaggccttgtctccttgaccacactctggagggcctactgctcacccagcagctccaggccagctccagcctgactacaccatcaaacttctccgctatccagtggctgaactacagcttttccaacaaagtccaaactccttccaagtttgcccttccttgggcatttatgaaaatactacagctaacatcatactaacggtagaagactgagtaacttccccctaacatcaggaataaggatgtccgcccttatcattcaacattgtactagcgtttctagccagtgccatcagtcaa

SEQ ID NO: 383764 - DNA, 487 bp, Homo sapiens
cccagcaaaccttgctcagaggtagaccacaccgagcaacagaaagaatgccacttggctaacataggggtgttggcaagctgtggcccactgtctgtttttataaataaagttttattggcacagccacggccatttgtttaggtaggtgtatggctccctccactctacaatggcagagttgagtagttatgccagagattccatgacctgtaaagcctcagatatttactatgtagccatttccagaaaaaagtttgccaacctcttgtcaaacattagccaaatccaggtccctcttcctcacagtttcattctgacagcctttaaaaacgagaaaatggaaactacctaaaaaacaggcagcacttgcttcctaaagaaacgaacaacaaaagcaactgattttcaaagactcttcttaatagatgagttgtcttatcatcaaagcatgtgttctgggccaagtatagaagcagctctgtga

SEQ ID NO: 383765 - DNA, 353 bp, Homo sapiens
gcccatcctggctaacacggtgaaaccccgtctctactaaaaatacaaaaaattagccaggcgtggtggcgggtgcctgtagtcccagctacttgggaggctgaggcaggagaatggcatgaacccgggaggtggagcttgcaatgagccaagattgcgccactgcactccagcatgggcgacggagcaagactctgtctcaaaaaaataataataataataaaataaaaagtttgttagtattagcagatacatattactaggtaccccccatgctcaatgaagtgttgggttactctgaaaaagtgtccaatcttacaggtgtgacttcctctggaactgcaagttcttga

SEQ ID NO: 383766 - DNA, 265 bp, Homo sapiens
cacaacaaaaggtctatcacagtgttatggtattatcaaaacattatgatgataaaaataactttctgtaataatgttgaagatatgagtgctagaaggaggttcagagagaaaaatcaaagcattatagataatagtgggacaacacagtggcatatgtagggcagagtagagaaatatctgggagtgaagttggtaccagtttaaaaggacatggtcccattccctagaattcccatagaaaactgagacaaatgcttcaaat

SEQ ID NO: 383767 - DNA, 425 bp, Homo sapiens
attcggcacgcgcggctttttaaatgaccccaggcgtgtgtggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctcttctgtaatctcagcttctgggggataggcatggtgttccattctgcatgctgctcgtcacataataggccctccagaaatactactgaatgaataaatgcatctaatagtctgataattttatct

SEQ ID NO: 383768 - DNA, 477 bp, Homo sapiens
tctttatatgtgtgcctcagcaactttttgtggtttataggataatgtccactctccttaacagctgcacctagagtcctctgccttctgctgctgccagaaggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctcttctgtaatctcagcttctgggggataggcatggtgttccattctgcatgctgctcgtcacataataggccctccagaaatactactgaatgaataaatgcatctaatagtctgata

SEQ ID NO: 383769 - DNA, 511 bp, Homo sapiens
catgatgtattttcacatatgttgtctttaatttactcctcttaataacccttgaagaagcatgacagccattgtcatcattcctgttttcccgattaagaaattgagattcagagaggtcaaataacttgcttaagatgaccgaaaagagtctaggcttttaattaatcctagacctggcactcgtcagtttcagaacttttcgggaatgacattggatttgctaatttcatcaagataatctgattgggggtgaacatttcaggttaaggaaaatactagtttttttcttttttgcctcattttatgggaattgctattatgtgttaggataatttggtttgaagcaactttgtacaatgtggcatcaaatagcagttaccttctaaaactgtactgaatcatataagtactgccatccagcaataaatatatgtataataaaattaaccttattgagcagagtagtgtggtactactttggtaggacttcctgtttgtgatccttatt

SEQ ID NO: 383770 - DNA, 188 bp, Homo sapiens
aaatgtaatgtcctctatacatttcctcctttgaaaaatggggatctgggaagattggtaagatctttagcattagactttcatttctgcatcatcttgatttactgtgtctgtgcccaataccccatcatatcacatataatcgttccaataacctagatctactgaaaaaaacctttgaaaaatga

SEQ ID NO: 383771 - DNA, 308 bp, Homo sapiens
ccctctcaccctttgttttcctttaatcctcactattattctaaaaggaggtgctcttattaaccccactgtataggtgagaactgagccactgcatatggggctaaaaggaaacaaacacccctgtaaaaaccccatcattttaaattatctatttaatcgttaagaaatggtggttaggccacgttcggtggctcaagcctgtaatcccagcactttgggaggctgaggcgggcggatcacgaggtaaggagttcaagaccagcctggccaacgtagtgaaaccctgtctctactaaaaatccaaa

SEQ ID NO: 383772 - DNA, 1478 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383773 - DNA, 594 bp, Homo sapiens
gcacaatagctagtagaggcctggttaatcggcgagggagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383774 - DNA, 578 bp, Homo sapiens
ccgggcgacaacttaggctaggtcgaggctgggtgttagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383775 - DNA, 594 bp, Homo sapiens
caattcaggctaggtgcgggctgggtgttgaatcggccgagggtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383776 - DNA, 971 bp, Homo sapiens
caattcaggctaggtgcgggctgggtgttgaatcggccgagggtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaataaccaaacaaaaaaacaaaaaaacaacacacacacaaaccggggggcacaaggggggggggggaaaaagggcaacaaaatgtggccagcggcacacaagggtccggacccagtctcgggaaccacgcggaaaactggggcaccccaagaggagcgcataaggcgaacacgcgggtaccggttagacgggcacacttccacaggccgagcaccgcgagaacgaggggcacacacagggaggagcacaacaggagacacacgacacaacacggaagaacccaacgacacacacaagacaagaacacagacaaaaagagaagaaaagagaagagacgacgacggacccccgagacggcacgcacggctagacgagcccg

SEQ ID NO: 383777 - DNA, 569 bp, Homo sapiens
ggctagtcgaggctgggtggtaatcggccgaggcagcggcggcgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcgggacccacgctgtctgcgctggctccacccgggaacccgccgcacgctgtgttctaggcccgcccaccccaaccttctggtggggagaaataaacggtttagagactaaaaaaaaaaa

SEQ ID NO: 383778 - DNA, 1115 bp, Homo sapiens
attacaaaaacaggatgtcaaaatattggaaagacatatatgtatcgccccattatgtaaaaaaaacaaaattgaaaaaaggggaaagttgtacaaagccaaaaagtagggaaacccaaggttattacccagacaaaacgttttaaaaacaaggcccaatgaattgtaaaaaactcaactataggcaaatatgggtaacaggcccccttagggcacaagtaagatctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383779 - DNA, 557 bp, Homo sapiens
aagcagtggtatcaacgcagagtgcccattacggccgggggcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383780 - DNA, 231 bp, Homo sapiens
  misc_feature (10)..(10): n is a, c, g, or t
gcggccgccnactactactactactgctcgaattcaagcttctaacgatgtacggggacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383781 - DNA, 858 bp, Homo sapiens
  misc_feature (576)..(576): n is a, c, g, or t
aggacccgtccgcggttgaaactctgcggccacggacggcggctacgccgtagctcagcggcggcgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcaccttcgcctaagagccgcagggacccacgctgtctgcgctggctccacccgggaacccgccgcacgctgtgttctaggccggccaacccaacttcgtgcntggcgggagacaactacgcgggtttaggagacttacaaacacagccacaaccaacgaccacaccaacacttgttgcggcggcccgcggccccgggaaaaaggttctctacccccctcccgtgtgggcgccggccccccatgtgtcagcggacacgcggccatacggggcccacaggaaacccgggcctgcacggggggggccccccaataaaaacgcgcgggcgccccggggtttcggacccccagggggttgagcacccggctccacggagccacggcgtc

SEQ ID NO: 383782 - DNA, 758 bp, Homo sapiens
  misc_feature (571)..(572): n is a, c, g, or t
cttagggctaggtacgaggcctgggtgttgcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactannaaaaaaaaaaaaaaaacaaaacaaaaaaaaaaaaaaacccgggggctcatttgggggggggggagaaaaaggggtaaaaaggggccggggccaaggggccggaccacatttttggcacaagaggggaaaaagggcgggccccaaagagggggcggaaaaaggaaaacgcgggaccgataagaacga

SEQ ID NO: 383783 - DNA, 619 bp, Homo sapiens
gaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactggtgggtctatctttcggtctttcctaattttcccgtcctctggggaaa

SEQ ID NO: 383784 - DNA, 570 bp, Homo sapiens
cttagggctaggtacgaggcctgggtgttgcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383785 - DNA, 579 bp, Homo sapiens
ccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttggtatgtatcctctctgggtggagactgtccctgtctgagtgggtactggctaacagctgcccactgaggggcttcagccaggcatccactaggtggcactttctgccacaagtttgtctccat

SEQ ID NO: 383786 - DNA, 1755 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1631)..(1631): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaacaaaaaaaaaacaaaaaaaaacaaaaaaacaaacaaaaacacaaaaaaaacnacaaacaaaacaaacacaccgcggccaggcaaacataagaggcgcggcgcggggagacaaagaagcggcgacagcacaccgccgcgaccggcggtcccacaactcggcgtctcccgcacgcccc

SEQ ID NO: 383787 - DNA, 1927 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1612)..(1612): n is a, c, g, or t
  misc_feature (1637)..(1638): n is a, c, g, or t
  misc_feature (1644)..(1644): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaacaaaaataaaaaaaaaaaaaaaaaaaaaanaaaaaaaaacaaaaaaaaaataaannaaaaanaaaggggggggcggcggccgcaagaaaaaatcccccccgcggggagggccccccatattggagggcgcataccccggccttttttttgatcaacacaggggggtcccccccaaaggaggcggtgccattatacgaacgccgcgccggggggccgcccttgtaacacacacccgctcgtgtgcgcgggaacacacgacgtgcgctccgtgcgagcgactctggcgggggagacacccccatccacgtggggggggacaagccttgtggcgcacgatcccgctca

SEQ ID NO: 383788 - DNA, 1720 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaacaaaacaaacaaaaaaaaacccgcggggccctctattgccgggggggcggccacaaagggcgcctggaactgggccccaggggccacaacgggttcctggcccccgtttccgtggcccaccggggaacctcgcgcgggcccca

SEQ ID NO: 383789 - DNA, 1559 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1534)..(1534): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggccgcccacaacaccttntgtggaaatacatccgttggggtgt

SEQ ID NO: 383790 - DNA, 1567 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383791 - DNA, 1563 bp, Homo sapiens
gaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383792 - DNA, 1765 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383793 - DNA, 3975 bp, Homo sapiens
gaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383794 - DNA, 1580 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383795 - DNA, 573 bp, Homo sapiens
  misc_feature (56)..(56): n is a, c, g, or t
cggaacgccgctagaggccgtcatgagtgccggtggaaggctcttaagggcgtgcntctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383796 - DNA, 1672 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1473)..(1473): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccncgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383797 - DNA, 3581 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgccttgccttcaggagctcccttccccttggacactctaaccttgcccatggccttgcatcttttgcgcttcatcgctcaggctttgggcatttgcgcctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383798 - DNA, 3245 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgccttgccttcaggagctcccttccccttggacactctaaccttgcccatggccttgcatcttttgcgcttcatcgctcaggctttgggcatttgcgcctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383799 - DNA, 1736 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1501)..(1501): n is a, c, g, or t
  misc_feature (1505)..(1505): n is a, c, g, or t
  misc_feature (1508)..(1508): n is a, c, g, or t
  misc_feature (1512)..(1512): n is a, c, g, or t
  misc_feature (1523)..(1523): n is a, c, g, or t
  misc_feature (1532)..(1532): n is a, c, g, or t
  misc_feature (1534)..(1534): n is a, c, g, or t
  misc_feature (1540)..(1540): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggggaacccngccngcnacgnctgtggttctnaagggcccngncccaancccccaaagccttcctgggtggggggaagaaaataaaacggggttaaagaagaactaaaaaaaccaacgaaacaacaccaaaaggcacgggaagaaaggacaagcagcacaggcgggaacgctaaaacacacaggcggccgacgaaaagacagggacacacaagccgcgacgagacaccaaacaggcggccggcaa

SEQ ID NO: 383800 - DNA, 1568 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383801 - DNA, 1577 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcgggacccacgctgtctgcgctggctccacccgggaacccgccgcacgctgtgttctaggcccgcccaccccaaccttctggtggggagaaataaacggtttagagactaaaaaaaaaaa

SEQ ID NO: 383802 - DNA, 1638 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactacagcgtgcgcgggattcccggcccgcccaccccaaccttctggtggggacgaataaacggtttagagact

SEQ ID NO: 383803 - DNA, 1943 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1819)..(1819): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaacaaaaaaaaaacaaaaaaaaacaaaaaaacaaacaaaaacacaaaaaaaacnacaaacaaaacaaacacaccgcggccaggcaaacataagaggcgcggcgcggggagacaaagaagcggcgacagcacaccgccgcgaccggcggtcccacaactcggcgtctcccgcacgcccc

SEQ ID NO: 383804 - DNA, 1981 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaaaaaaaaaagaaaaaaaaaaaacaacgcggggggggaaaggtgatagcaaagcacacgagagtcgtgttggtcagcaccagcggagtggtaaccacccccacccacgaggcagaaaaatcggtgagaaacgaacaccaccacggagagagcatccctacaaaagatcgacgcccgacgcaaagagtgcttggtggtcaacccatgaatgagaaccaacgtgtcgccactcccacgagagggaacacgtgccaagggaccctcgggacactgcttctcaacacaaacgcgcgggacctgtcgctcaccggtgtcctccctgctagagaggaggcctcagacttgagagcaccgccccggggataaatattgccggacagaggggcacggagtcaccgc

SEQ ID NO: 383805 - DNA, 1750 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaacaaaaaaaaaaaaaaaaaaaaaacaaaaaacccgcggggcgtctttttgggggggcgcgaaaaaaaggttttaaagtgggcagtggtctatgttttttctgacccgttttttttccacagtggaaaatgggggcccctaaagggcgattattcgaaaccgttacttactcg

SEQ ID NO: 383806 - DNA, 1571 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383807 - DNA, 2128 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaaaaaaaaaaaaaaaaaaaagggggggccggccctaaaaatttccccgggggggccccacatttttagagcggttacccaacgtttttttgtgtgcaaagaggggggccgccaataagaggagcgtccgctattatatatgcctaagagaacgcgtggccggcaggtttttaaccaacagtgtcgggaacggtgggaacaaagtgtgtcaccggttggagaaacctttgggagaagagggaacccataaacatcgggaggggggagaacaaaatatgtgggacacacatttactctacgaggaagaattataaggcctctaagggcacaattttaacacttttaaacggttataa

SEQ ID NO: 383808 - DNA, 1760 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383809 - DNA, 1450 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcgggacccacgctgtctgcgctggctccacccgggaacccgccgcacgctgtgttctaggcccgcccaccccaaccttctggtggggagaaataaacggtttagagacta

SEQ ID NO: 383810 - DNA, 537 bp, Homo sapiens
gcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383811 - DNA, 266 bp, Homo sapiens
aataaagtcacactgaagcaataaactaccctcacctccaccaccagctttctcaggagaccccttcccattgcctgccccagacctcagggaccatggctgggtgtgtgggtctgtgctttctgcctttgcagtgtgtggtaatcgagagggtgggtcggcgcgtgctgctcatcggtgggtacagcctgatgacctgctgggggagcatcttcactgtggccctgtgcctgcaggtagctggggtggatgagggctggggggtc

SEQ ID NO: 383812 - DNA, 810 bp, Homo sapiens
gactctggcaaagaggcatctggcctggcctctcctctgcctccttagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcaggtgagtctctgtccttgggctcccagactgcccttgaccaagggatgcatctccccagagtatacgggtccccatttcataggtttcatttatcaaggaaaagctatccctctctttgtgcctcaatttcatgatctgcctatacctgccttcaatcagaactctatcaagtggttgtcctaactgccaggcagcagaatggatcagacctagccactgttactcaagaactccagagcggtgcggagaaacacacgcgcacacacacggtgaaacacctgtgcaagacctcacctacccagtgccaactgggtgatggtcatcttatatcagttaactttggctacagtaagaatgcctaaggaacaatcgcaacatttctgctttaaagcaacaattatttactgcttcttttattcatgtacttgcctggctggctgcacagctctgctgatctcagctgggctagttcacagtgtggggcgggggaggggggcagtggtgaggttcagctgctggttggccggtctaggctggtctggactggagccattcagctttgctgcactttctgtcctctcacttttggtaccaacgagttagcctaggaata

SEQ ID NO: 383813 - DNA, 866 bp, Homo sapiens
gaggggggcaaatgcctcctcacgacctgtcatgggccttctgtttaggggttgatggagacacaccaggtcttggggtcttttttaatccgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggcc

SEQ ID NO: 383814 - DNA, 587 bp, Homo sapiens
gagacctagctagtgggctggggtgtaatcggccgagcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383815 - DNA, 756 bp, Homo sapiens
  misc_feature (632)..(632): n is a, c, g, or t
ccgggcgacaacttaggctaggtcgaggctgggtgttagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaacaaaaaaaaaacaaaaaaaaacaaaaaaacaaacaaaaacacaaaaaaaacnacaaacaaaacaaacacaccgcggccaggcaaacataagaggcgcggcgcggggagacaaagaagcggcgacagcacaccgccgcgaccggcggtcccacaactcggcgtctcccgcacgcccc

SEQ ID NO: 383816 - DNA, 999 bp, Homo sapiens
  misc_feature (821)..(821): n is a, c, g, or t
gagacctagctagtgggctggggtgtaatcggccgagcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaacaaaaataaaaaaaaaaaaaaaactccgggggttatttttggggggggaaaaaaaaagtgatttaaaaagggcatgggcacaaagtgtttctcggcgccccatttttttggacacaagggggaaaaacacggcggggccccccaaaaagggaagcgcgataaaaattcaagaaaaccccggggttacccggtaagagtagcgcggcaaaaagcacaagacgagcgacanagaagacgcacgaacgaagcaaagagcgacaacaagggaaagaagcagcaacaaggacaacacaagacaacaggatacaaaacacaacaacaaacaacaacagagagagcaagaaagcaaacagcgaagcagacaacgagacgacagcaaacgaagagagacacagaacaccacgacc

SEQ ID NO: 383817 - DNA, 647 bp, Homo sapiens
gcacaatagctagtagaggcctggttaatcggcgagggagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaacacaaaacacattccactggcgtcgtttaccgtcgtgctgggcccgggcgg

SEQ ID NO: 383818 - DNA, 474 bp, Homo sapiens
gcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcaccccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383819 - DNA, 750 bp, Homo sapiens
  misc_feature (634)..(634): n is a, c, g, or t
  misc_feature (640)..(640): n is a, c, g, or t
  misc_feature (647)..(647): n is a, c, g, or t
  misc_feature (750)..(750): n is a, c, g, or t
aagcagtggtatcaacgcagagtgcccattacggccgggggcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactagtgccgaattcggcacgagctagccgtcgcgtacctaggatgccgcgtggaagccgaaagccgacctcccgcatggncccttncggcagncgggcccctcagatgagagcttgacccaggccagcaccaatcgctcaggcaccagcaggggcacccccatctgcaggtggctcctctggtgctgcgccccggn

SEQ ID NO: 383820 - DNA, 974 bp, Homo sapiens
  misc_feature (675)..(675): n is a, c, g, or t
cgcaaagataatgatagacgaatactagtgtatgcagtagaggctgtgcttacttcgatttactgcttcgtgccatcatgccgatgttcatcgtaaacaccaacgtgccccgcgcctccgtgccggacgggttcctctccgagctcacccagcagctggcgcaggccaccggaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaaaaaactggggggtttaattgggggggggaaaaggggttatggaatgggcctgggcaaaaggtgttctgggaccagtttttttgtacaaggggggaagatcggggggccccaaaagggnggggcgaaattaaatttgcgaaaaagcccggggttacctggttagtatttgttgtggcagcaaacaagggggagtacaaaacaggcacaagagcgggggcagtgaggtctggccagcagagacaacgcagggccagcatagggggacgaacagccgcgggcaagacaaaaaccacgacaagcgggtggtgtggtgccaaaaaaagccaaatacagaaggaatgtgtgcagcaggccaccactgtggatcggggacaggggcgcggacggtgcagaacgggataagagatgtgcaacggc

SEQ ID NO: 383821 - DNA, 354 bp, Homo sapiens
gcacgtagctcagcggcggccgcggcgcgtgcgtctgtgcctctgcgcgggtctcctggtccttcagcctgcacagcatcggcaagatcggcggcgcgcagaaccgctcctacagcaagctgctgtgcggcctgctggccgagcgcctgcgcatcagcccggacaggcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagacta

SEQ ID NO: 383822 - DNA, 1577 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383823 - DNA, 1989 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1811)..(1811): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaaaaacaaaaataaaaaaaaaaaaaaaactccgggggttatttttggggggggaaaaaaaaagtgatttaaaaagggcatgggcacaaagtgtttctcggcgccccatttttttggacacaagggggaaaaacacggcggggccccccaaaaagggaagcgcgataaaaattcaagaaaaccccggggttacccggtaagagtagcgcggcaaaaagcacaagacgagcgacanagaagacgcacgaacgaagcaaagagcgacaacaagggaaagaagcagcaacaaggacaacacaagacaacaggatacaaaacacaacaacaaacaacaacagagagagcaagaaagcaaacagcgaagcagacaacgagacgacagcaaacgaagagagacacagaacaccacgacc

SEQ ID NO: 383824 - DNA, 1954 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaataaccaaacaaaaaaacaaaaaaacaacacacacacaaaccggggggcacaaggggggggggggaaaaagggcaacaaaatgtggccagcggcacacaagggtccggacccagtctcgggaaccacgcggaaaactggggcaccccaagaggagcgcataaggcgaacacgcgggtaccggttagacgggcacacttccacaggccgagcaccgcgagaacgaggggcacacacagggaggagcacaacaggagacacacgacacaacacggaagaacccaacgacacacacaagacaagaacacagacaaaaagagaagaaaagagaagagacgacgacggacccccgagacggcacgcacggctagacgagcccg

SEQ ID NO: 383825 - DNA, 1041 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383826 - DNA, 1238 bp, Homo sapiens
ccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383827 - DNA, 1072 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggagcctctctttctgtgtgtttcacttcccccaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383828 - DNA, 3564 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383829 - DNA, 4086 bp, Homo sapiens
gaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383830 - DNA, 3415 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctaccaaaaaaaaaaaaaaaaaaaaattagctgggtgtggtggtacatgcctgtggtcccagctactcaggaggctgaaatgggaggatcacttgagcctgggaggtcgaggctgcagtgagtcctaattgagccactgcactccagcctggacaacagaaagagaccatgtttcaaaaaaaataaatacaggttgtagtgggtatgggtatgcataccaggaggcccgacctcgtctgagaggggagtggtcagaaaagaattttctgaggaattgatgtttttaatcaactttattgaggtataatttatacataaccaactgcatccattttaagtatatatttggcgagttttgagttctaagtatagttttggtgagtgtatacacttgggaaacaccaccgcgatcaagatggaacctttaccctaccccaaggcacccacatgcccatttgctatcagtaacccaccccagtcccagacctggggaaccactgacctgctttctgcctcaattggtcagatttgccttttttcagaatctgaagtcattccgtactgtatgtacacatttgtgtctggcttggctccagataaagtttttgggattcatgaatgttgttgcacgtattaggagagactcctttgtattgctgagtagtattcccctctgtggttagaccatgatttatttatccatctacctgttggtgaacattttggctgtttctaattcttggccatcatgaataaaactgctgtgaatgttcctacaataataattgtctaaacatatgtttttatttcttttgtgtcttagtccgtcgggctgctataactaagaaccacagcctgggtggcttataaacaacagaaatttatttttcatggttctggaggctgggaagtccaagatcaaggtgccagtggattcagtgtctgttgagggcccatgtcttgattcatagatggcggtcttcttgctgtgttctcctagacatggcagaaggggcaagggagctctctggggtctcttttataagggcaccaatcccattcatgcaggctctgccctcatgacctaatcacctcccaagaggcccaaaggccctacctccaagtaccatcatatgagggattaggtttcaaggtatgaacctggggaggacataaacagtcagtctagctttttgggtaaatgaattgctgggcttaataataaatgtatatttaactgtaaaaaaaaaaa

SEQ ID NO: 383831 - DNA, 2470 bp, Homo sapiens
gaatggtttaccattagaaagtttattgatgtaactgatctcattaacagattaaaggagaatacccatatgatcatcttaatagatgcacgaaaagcatgcaataaaatacctatttattataactgctaatattttgtgtttttccttaaaaatgcagtgtttttaggaattaaagttcagagcagcaaaagtcaaacaaaaaccaagtctgagcaatagagctactacagtgcccatcacagtgtctgctcaggtgacttcttaaggtcatgtccagctctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacatgttctcacttaaaagtgaaagctaaatgatgagaactcatggacacatgagaggggaacaacacacactgggacctagttgagagtggaggttaggaggagggagaggattgggaaaaataactaatgggtactaggcttaatacctgggtgatgaaacaatcggtgcaacaaacccacatgacacaagtttacctatgcacaagcactaccaac

SEQ ID NO: 383832 - DNA, 1860 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
  misc_feature (1661)..(1661): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccncgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaa

SEQ ID NO: 383833 - DNA, 1219 bp, Homo sapiens
  misc_feature (1095)..(1095): n is a, c, g, or t
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagtacatcgcggtgcacgtggtcccggaccagctcatggcttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaaaaaacaaaaaaaaaacaaaaaaaaacaaaaaaacaaacaaaaacacaaaaaaaacnacaaacaaaacaaacacaccgcggccaggcaaacataagaggcgcggcgcggggagacaaagaagcggcgacagcacaccgccgcgaccggcggtcccacaactcggcgtctcccgcacgcccc

SEQ ID NO: 383834 - DNA, 1710 bp, Homo sapiens
  misc_feature (10)..(10): n is a, c, g, or t
  misc_feature (198)..(198): n is a, c, g, or t
  misc_feature (202)..(202): n is a, c, g, or t
  misc_feature (206)..(206): n is a, c, g, or t
  misc_feature (228)..(228): n is a, c, g, or t
  misc_feature (378)..(378): n is a, c, g, or t
  misc_feature (500)..(500): n is a, c, g, or t
  misc_feature (517)..(517): n is a, c, g, or t
  misc_feature (568)..(568): n is a, c, g, or t
ctggtgcacngagggtcccacaggcatgggtgtccttcctatatcacatggccttcactgagactggtatatggattgcacctatcagagaccaaggacaggacctccctggaaatctctgaggacctggcctgtgatccagttgctgccttgtcctcttcctgctatgtcatggcttatcttctttcacccattcantcantcantcaattcattcagcagtattantcaatgtctcttgtaatgcctgcacctgctagatggtccccgagtttaccattactggaaaagacatttaagaaattcaccaagggctctatgagaggccatacacggtggacctgactagggtgtggcttccctgaggagctgaagttncccagaggcccagagaaggggagctgagcacgtttgaaccactgaacctgctctggacctcgcctccttccttcggtgcctcccagcatcctatcctctttaaagagcagggttcagggaanccctggatggtgattcncagggcagctcccctctcacctgccgcgatgactaccccgccccatctcanacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactacagacacctcggggggggcgcggtaccaattcgcctatagtgagtcgtttacaatccctggccgcgtttacacgtcgtgctggagaacctgggttaccacttatcgctggagtcccttggcagggggtatgcgaggccg

SEQ ID NO: 383835 - DNA, 1057 bp, Homo sapiens
agcgcctctttcaccactgggcgctgcgcgctgcccttccctccgcgcacaggctgccggctcaccgcttgctaatggcagccggggtctccctgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactcca

SEQ ID NO: 383836 - DNA, 743 bp, Homo sapiens
  misc_feature (56)..(56): n is a, c, g, or t
cggaacgccgctagaggccgtcatgagtgccggtggaaggctcttaagggcgtgcntctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggaccagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactaaaaaaaaacaaaaaaaaaaaaaaaaaaaaaacaaaaaacccgcggggcgtctttttgggggggcgcgaaaaaaaggttttaaagtgggcagtggtctatgttttttctgacccgttttttttccacagtggaaaatgggggcccctaaagggcgattattcgaaaccgttacttactcg

SEQ ID NO: 383837 - DNA, 565 bp, Homo sapiens
atctggtgatgggaatgggatgggagctggggccttcctaggagctggagcccagccaggtgagggcagctggaccacactgggattctagaagacacagggaagaaccaggggatatcagaggtccagaaggcagaaagtttatttctgggggaggacaggggatgggtggggtccgtgagcccctgctctcctctcccctatcttgactgtctcctccatgctagaaccacaaacgtgcttccctgcttgcctccgcgtgccatgcaaggggcttgctgaccagggtgggagtggcatgggcctgcagccaccacccagcacctcattcattcatttggcaaacatcaatgaggccatgtgccagggaccatgttcccaacaggagaaatcatgagaagaaaacagactcgatcaacgcctgccctcagggagggcatcacttggtgaccgcctagcgggggaaccacatccaagttaggggccttgtgcatggaaaagaacacttcattctttgtgttttcatttataatcgatttattaaagttgttagataaaaatctca

SEQ ID NO: 383838 - DNA, 491 bp, Homo sapiens
aggcagcaatggccagctggggaatggctacggaggccgctgccctctggggaaatgctgagcactgcaatgcccctcgcctgcccagcaaggaagacagacccttgggcttggcctctggtgctgcctggccgggggtctcctccatgctagaaccacaaacgtgcttccctgcttgcctccgcgtgccatgcaaggggcttgctgaccagggtgggagtggcatgggcctgcagccaccacccagcacctcattcattcatttggcaaacatcaatgaggccatgtgccagggaccatgttcccaacaggagaaatcatgagaagaaaacagactcgatcaacgcctgccctcagggagggcatcacttggtgaccgcctagcgggggaaccacatccaagttaggggccttgtgcatggaaaagaacacttcattctttgtgttttcatttataatcgatttattaaagttgttagataaaaatctca

SEQ ID NO: 383839 - DNA, 335 bp, Homo sapiens
cctcagagactgctggtaaagtccagaaatatgaggacctcattgcccacagaaaggctcagttaagaaagtcaagaggacaagtgaaaacaagagtgagggtgaggatcaacctgagcctgagccgggaagaccagaggcatccaaccagccttaggtcccacactgtggactcacaccaccactaagaaacatttgggatttccgacactcaaaaagtgacttcgtattggcatgctctatatgctgtcacatcatgcccttgtcacaaagacaaaagctctggtgggaaacacaaagcctcttcagaagccctattcagcctgcacttgcca

SEQ ID NO: 383840 - DNA, 317 bp, Homo sapiens
gcacgaggcacagggggcttttgtggcagcagaactattctatatgatatagtaatggtggatacatgacattatacgtttgtcaaaatctgtagactcatgccatggagtgaaccctaatgtaaaaatctatggattttaggtaataataatatcagttcatcagttataacaaatataacactctgagatatattgttaataggggaaattgtgcaagagtggggtggaggaaaggtcctgtgagaactctctgtactttctgtgtagtttttctataaagctaaaactgctctaaaaatactaagtctatttaa

SEQ ID NO: 383841 - DNA, 633 bp, Homo sapiens
aaacatgactgaattatatatccaagcttttaattctgttattgccctttgaaggatgatcacttttaaagtgttttttcctccattgggaaatttgtctgcttttggtaaattttcatagttcaatttgagtatgtatattatttttccatggaatactgagggttttatgcttttgaagaaatgatttaaagtttaaaatttctttctctacattgatctgctggttttaattctttgaatagcacttatgatcatttgatgctgttcttttttgttacttgattattcatctttctctccttagaatgtaagttctaaaagggcagcacatgttcttgatctttgccaaatctgtagtgtctcctgtagtagaacagatgctcgataaatatttgttgagttaatgaatgaacaatttaaaagattgtgagctgggcgcggtggcttacgcctgtaatcccagcactttgggaggccgaggcgggcagatcatgaggtcaggagatcgagaccatcctgtctaacacagtgaaaccccatctctactaaaaatactaaaaaattagcggggcatggtggcatgcgctgtagttccagctacttgggagcctgaggcaggagaatggcatg

SEQ ID NO: 383842 - DNA, 437 bp, Homo sapiens
aaagaaattctcccagattttggtcaccatgaaagagcgcaggcttcactgattcactttcaaaggctatattatcttgattctttgctgtcaaaaatagttgaaaccggttgagaaggagggtggccacaaacaggtccataattagcatgtttggtagcaaaaggtgggaaaggtcatcatcatcgttgtgcagggactgcctttgggatgacaagtcataatatgtgacaagtgttaagtatttacaacatcggacacatccctaagcaggctcatacattccctccctattctgcaaaccaacctagaaaggtaagtattgccatcaacattttgctaatgtgtaaacagggcattaaaagttatttaaggccacgtgcggtggctcacgcctgtaatcccagcactttgggaggctgaggcaggcggattac

SEQ ID NO: 383843 - DNA, 633 bp, Homo sapiens
ctgggcaattttataggtagaataaagtcaaataattatatgttcagaaaaaaaagatattctagaactgtcagtttgtacagaatgtatgtgtttagatacagactgagataatttgcatactaaaagagctcatgaccctgctcttgctagggcacgtgtttattataattaagaatgttttcctttatggagcacatgcacacaggcacccgttgaaagtgccaggctcgccactgccttaggtcccctattactctgcctggagtgctcttcctcactccctcccaccttcccccatcttgacctgactgatacttttatattcctcagttcagctcattggtcacctcttcagagaggtcatcccagacaacccttcctaaaatagttctccaagctctgtcatcattctccatcccattagcctgttttacatttgccattatctgaaataatcttacttatatgttttttacttgtttctcctcactagaatgtaatttctgtgaggttagagaccttgtctgtcttgttcaacactgtatccctaattgtagaatggcggatctttaatgaatattggtttaatgaattaatttaacttttttacattaaatgttaatcttagtt

SEQ ID NO: 383844 - DNA, 333 bp, Homo sapiens
agtgactttcagatacagcaacctagtctatgttatagaacattctaaaaagagcagattttaatatctttcctcccacacttgctttgactccctcctttagtaattagataattatgtataataagcacattaattatgtgcaacagctgccattgagtgtgtgcatgtacaactgcttgaaaacagcttgtgagttcactattaggtccatgaaatttttctccttggcaggttttcactattagtttgcttgacaaaggatagatacattttccatgtgtggaggtaaaagcagtgcagtgagctaaaaagttagcaaaggtgaagtgg

SEQ ID NO: 383845 - DNA, 310 bp, Homo sapiens
gacacgccttacatggcaccaggcaagagagtgtgtgttagggaactgccctttataagaccatcagatctcatgagacttattcactgtcatgagaatagcatgggaaaatcctgccccagtgatttggttacctcccactgggtccctcccacaacacgtggggattataggagctacaattgaagatgaaatttgggtagggacacagccaaagcatatcagtggttaaatgcatttgttggaagccttctggttccaaccaatatgaagtaacaggaactgaatttacattttcatctgaaacaga

SEQ ID NO: 383846 - DNA, 426 bp, Homo sapiens
aggtcagtatgtgattcgggcgagtgagaggaggaatgttactttgcttttctgtttcaaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383847 - DNA, 918 bp, Homo sapiens
atgctctcttttctactttcttgaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacccacttatggcacatacgttcctgtcttagaggcctggaactagcagatctcgtggaaagagttctttcccatggaaatgacaacacaggcaggtcatttgagtggaggcttaaaattcctcaggatactggatcagggtaaaagctgctccttagattccagatgagaatgtgtatggtgtgttcagcatagggaacacagcttttctggggaaatgacagtgcttccattgtgagccttgaagctcactgaacccaagacggatggcaggtggaagctctgctaaggagaggcccttcttacgcctctttctggggaacctgagcatgttagtgccttttaggtaatgttacttgtgcagcctaactgaaggatgaagtcctccagcttaccaccctagcccaccctggcttgccccgaactaaagatttatgtcactcattcaatcttctgggtctacaaaaccaggagaatggaagagaaatactaaaatgcagttgtctagcagccgtactccaattattagtcattagacctgcatgtgagatttagttacctcttcagttgttaattaacatcactacttcggggagtgcagagtcagggcttgattttctgcaggataaggggaacagatctgtgctgggggaagagctgagttgcagacaactcacaaaggccactgtgactagtattcctttctggcaaacatt

SEQ ID NO: 383848 - DNA, 2362 bp, Homo sapiens
gacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383849 - DNA, 2406 bp, Homo sapiens
aaagaggacaagaaaacttatttggactaagtagcgaggcccgtggggtgtgttatatcttcaggcacgagggtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383850 - DNA, 3504 bp, Homo sapiens
gacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcagttagaaattgtgttttcttcctgccccattgacatttctaaggccctaatgcatttgttctgaggtttgacagttgaagcccttcaccagtgctagggaaataaagcctcctcaaccttaaggatttcagtgataagagtctgaaagtctagcacttcaggtagactttggatgaactaagaggttccacagtcaccctgtcatataactgtctgacagaaataggggatgaggtctataaaatggaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacccacttatggcacatacgttcctgtcttagaggcctggaactagcagatctcgtggaaagagttctttcccatggaaatgacaacacaggcaggtcatttgagtggaggcttaaaattcctcaggatactggatcagggtaaaagctgctccttagattccagatgagaatgtgtatggtgtgttcagcatagggaacacagcttttctggggaaatgacagtgcttccattgtgagccttgaagctcactgaacccaagacggatggcaggtggaagctctgctaaggagaggcccttcttacgcctctttctggggaacctgagcatgttagtgccttttaggtaatgttacttgtgcagcctaactgaaggatgaagtcctccagcttaccaccctagcccaccctggcttgccccgaactaaagatttatgtcactcattcaatcttctgggtctacaaaaccaggagaatggaagagaaatactaaaatgcagttgtctagcagccgtactccaattattagtcattagacctgcatgtgagatttagttacctcttcagttgttaattaacatcactacttcggggagtgcagagtcagggcttgattttctgcaggataaggggaacagatctgtgctgggggaagagctgagttgcagacaactcacaaaggccactgtgactagtattcctttctggcaaacatt

SEQ ID NO: 383851 - DNA, 2566 bp, Homo sapiens
gacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagccctggcacctgacgttccacgctctgctgggctttccaggcctgctgtgcatcctctgcccatggagcccatgcagcttctatgtcctctggttggagagggccctgccaaaattcaagcttcagatccctggtcagacgtcagctcctgagggaagccgtggaaccagactaccctatcaaattcttaaagcttcatgttctttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383852 - DNA, 2100 bp, Homo sapiens
atttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaatttgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383853 - DNA, 2009 bp, Homo sapiens
aatagtaacatgataggaaactagtaccgtgaaggcaagctaaactttgtagttttttgtgaaatacacaaaacctataatattacaaacttaaagataatattacaaacttaaagaagtctaagaagtaaatgatttagttcaataatccatagtagttaggaaataagttgagtttcatctaagctagtttttctgttttaaattcagcaggtttcaaaagccacaggatgaaaaaccttttgaattctgatcactgggccttgagattagccacaacgaactctgcccagagactgttttgaagttgtctctaaatattattattttatttttcccagactcccttaaatgtcatccctcttttatttgtactgtagcaaaccatttttgcctttctgaattttcaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383854 - DNA, 1856 bp, Homo sapiens
ttaatctgtagatctctctgtatctatgagagtaagggattaggccaggcatggtggcacacgcctgtagtcccagctactggggagactgaggcaggagaatcgcttgaacctgggaggcggagtttgccgtgagccgagattgcgccactgcaccccagcctgggcgacagagcgagacttctcaaaaaaagaagaagaagatgtaaaaacttccagagatgtaaaaactcacagagcatcaggattataagagattctgaagtgttttcttgctcagcctttgcccccatccgtgaccagtgttgcttccatttctgccacagccctggcacctgacgttccacgctctgctgggctttccaggcctgctgtgcatcctctgcccatggagcccatgcagcttctatgtcctctggttggagagggccctgccaaaattcaagcttcagatccctggtcagacgtcagctcctgagggaagccgtggaaccagactaccctatcaaattcttaaagcttcatgttctttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383855 - DNA, 1046 bp, Homo sapiens
  misc_feature (20)..(20): n is a, c, g, or t
gattcgaattcgagctcggntcccgaatccagaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383856 - DNA, 1895 bp, Homo sapiens
gtattcattttatggtgatgcaaatgtttagaaattagatagaggtgatggtcgcataacatcgtgaatgtactaaatatcacagatagttatgtgacatttcatctttgtaaaaatatagtgacaacaccaaatgctggtaagaatgtggagaaactgaatcactcataacattgctggtgggaatgtaaaatggtatagccacattggaaaacagtttggcagtttccttaaaaactaaatatccagcaactatatgacccagtaattgcactcctgggcatttatcccagaggaataaagacttgtgtagacacaaaacttgcacataagtgtatgtggtagcactattcataatagtaaaaaactggaaacaactcagtaatgcttcaatgatggtacatgtatactatggaagactactcagcgatacaaagaaatacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcagttagaaattgtgttttcttcctgccccattgacatttctaaggccctaatgcatttgttctgaggtttgacagttgaagcccttcaccagtgctagggaaataaagcctcctcaaccttaaggatttcagtgataagagtctgaaagtctagcacttcaggtagactttggatgaactaagaggttccacagtcaccctgtcatataactgtctgacagaaataggggatgaggtctataaaatggaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacccacttatggcacatacgttcctgtcttagaggcctggaactagcagatctcgtggaaagagttctttcccatggaaatgacaacacaggcaggtcatttgagtggaggcttaaaattcctcaggatactggatcagggtaaaagctgctccttagattccagatgagaatgtgtatggtgtgttcagcatagggaacacagcttttctggggaaatgacagtgcttccattgtgagccttgaagctcactgaacccaagacggatggcaggtggaagctctgctaaggagaggcccttcttacgcctctttctggggaacctgagcatgttagtgccttttaggtaatgttacttgtgcagcctaactgaaggatgaagtcctccagcttaccaccctagcccaccctggcttgccccgaactaaagatttatgtcactcattcaatcttctgggtctacaaaaccaggagaatggaagagaaatactaaaatgcagttgtctagcagccgtactccaattattagtcattagacctgcatgtgagatttagttacctcttcagttgttaattaacatcactacttcggggagtgcagagtcagggcttgattttctgcaggataaggggaacagatctgtgctgggggaagagctgagttgcagacaactcacaaaggccactgtgactagtattcctttctggcaaacatt

SEQ ID NO: 383857 - DNA, 379 bp, Homo sapiens
aacaaagtaatacaacctacttgtccaaagggatatatatgactgcatgtatgtgctgtgtattctctctttgaacagttgcacactgacaagaaacagatcagtgttgggttcattggctatccaaatgttggcaagagctctgtgataaatacattgcgttctaagaaagtttgcaacgtggctcccattgcaggtgaaacaaaggtacgttgggcgcagggtgaccttacttttgcatattttcttttcatagagagtgattgtttaggacttgttgatttctctctgcttctcttgaatgcagaccaccactaggagtttagctcaccatataatagtttggaacgtatcagagttgtttctgcccactttgata

SEQ ID NO: 383858 - DNA, 2520 bp, Homo sapiens
gacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcaaaaaaaaaaaaaaaaaaaaaaaaagaaaaaaaaaaaaaaaaaaaccggggggtttttgtgggggggggagaaaagggtaaaggggggggatggtgtcggacacccttttggggaaagggggaaaggggggcccaaaggggggggaaggagggggagag

SEQ ID NO: 383859 - DNA, 2107 bp, Homo sapiens
tcaaaaatgaagtgccaatgaggccgatcaccgggtgtcaatgcatgcgagtaggctcgatgcacggtgacttacaggtgcagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383860 - DNA, 1723 bp, Homo sapiens
aacggctaggtagaggacggggtgttatcggattggtactgaccgaactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383861 - DNA, 1356 bp, Homo sapiens
tggctagtcagccggggtaatcggacgaggttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaaaacatacaagattgattcttgggagaatgctgaggactttcttgagaagctcgctttccggactgggaagttactaaagggtggagagcccgacttgcagactgtgggtaagatggtcctcaatgactggcagaggggccggattcctttctttgtcaagccacccaatgcagagccacttgtggccccccagcttctaccctcctcatctttggaagttgtcccagaagcagcccagaacaatccaggggaggaagtcacagaaactgcaggtgaagggtcagaatccatcattaaggaagaaacagaagagaacagtcactgtgatgctaacacagagatgcagcagattctcacacgagttcggcagaactttggtaaaatcaacgtggtgcctcagttttctggggatgacctggttcctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383862 - DNA, 1715 bp, Homo sapiens
gacgtacgtcgtgcacacgtggtccggcgtggttcaggcgggtgtcttcggccgggcttgggaacataaaagtttgtttcaccacgtaagccggacctcgcactccggtcccggtctcgtcgccaagatggtgaagcccaagtacaaaggacggagcaccatcaacccgtccaaggccagcacaaacccagatcgagtgcagggagcaggaggccaaaacatgagggaccgggccaccatccggcgcctgaatatgtataggcaaaaggagcgcaggaacagtcgtggtaaaataattaaacccctgcaatatcaatcaacggtggcttctggcacagtggcaagagtagagccaaatattaaatggtttggaaacacacgtgtgattaagcagtcatcattacaaaaatttcaagaggaaatggatacagttatgaaggatccatacaaagttgtcatgaagcaaagcaagttaccaatgtctcttctccatgatcgaatccggcctcataacttgaaggtgcacattcttgatactgaaagttttgaaactacatttggccctaagtcacagaggaaacgaccaaacttatttgcaagtgatatgcagtctcttatcgaaaatgctgaaatgtccactgagagctatgaccagggcaaggatcgtgatttggtaactgaagacactggtgtgagaaatgaagctcaagaagagatctataaaaagggacagtccaaaagaatatggggtgagctctacaaggtgatagattcatcagatgttgtagttcaagttcttgatgctagagatccaatgggtactcgttcccctcacattgaaacttacctgaagaaggaaaaaccttggaaacacctcatttttgtacttaacaaatgtgaccttgttccaacctgggcaacaaaacggtgggttgctgtcctctcccaggattatccaacacttgctttccatgcaagccttactaacccgtttggcaagggagcattcattcagcttctgcggcagtttggaaagttgcacactgacaagaaacagatcagtgttgggttcattggctatccaaatgttggcaagagctctgtgataaatacattgcgttctaagaaagtttgcaacgtggctcccattgcaggtgaaacaaaggtctggcagtatattactttgatgcgtcggatattcctgattgactgtccaggtgtggtttacccctctgaggactccgagacagacattgtgctaaaaggagttgttcaagtagaaaaaattaagagtcctgaagaccacattggtgctgtacttgaacgagcaaagccagaatatatcagcaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggca

SEQ ID NO: 383863 - DNA, 1974 bp, Homo sapiens
agttcgacggagactctcactgtgtccttggaggctccgcctacccggcggatgttacaagcacaccatctcaaatgcagtcgccattgcaacaggctgcaggtcgcttatcacaaggcaccgaagacaagctctttcaccctcggccacatctctcctgcaagccccctctgtgccatcttctagaagttttacagttatgcaatttacatgtctgtctacgatttatttttatttaatttctgtggaggtgtcagatcttgaggaagagcttgagagcttttctgatgaagaggaggaggaacaggagcaacaaagagatgatgcggaagagtcttcctcggagcctgaggaggaaaatgtgggaaacgacaccaaagccgttattaaagcactggatgagaagattgccaaatatcagaagtttctagacaaagccaaagccaaaaagttttcagcagtcagaatatccaagggactgagtgaaaagatatttgcaaaacctgaagaacaaagaaaaacactggaagaagatgtagatgacagagcaccttccaaaaagggaaagaagcggaaggcacaaagggaagaggaacaggaacattcaaataaagctcccagggcgcttacatcaaaagaacggaggcgagcagtacgacagcaacggccgaaaaaagttggtgtgcgctactatgaaacacacaacgtgaaaaataggaacaggaacaaaaagaagaccaatgactcagagggacagaaacacaaacgcaaaaaattcagacaaaagcagtaatgtttaaaaggtttttattaaattatacaaaaacaggcagttagaaattgtgttttcttcctgccccattgacatttctaaggccctaatgcatttgttctgaggtttgacagttgaagcccttcaccagtgctagggaaataaagcctcctcaaccttaaggatttcagtgataagagtctgaaagtctagcacttcaggtagactttggatgaactaagaggttccacagtcaccctgtcatataactgtctgacagaaataggggatgaggtctataaaatggaaagggtggtatttcgtttttattggtaatgaatgatttggaatagaagcatacagaactgcaaatttcaaggacgttagtgtacatggcctggcctttgaaatacaaggagaaagttgggtgcagaagaaataggagaaaactacaataatttctgcctcattgagtctgtgaagtagacccacttatggcacatacgttcctgtcttagaggcctggaactagcagatctcgtggaaagagttctttcccatggaaatgacaacacaggcaggtcatttgagtggaggcttaaaattcctcaggatactggatcagggtaaaagctgctccttagattccagatgagaatgtgtatggtgtgttcagcatagggaacacagcttttctggggaaatgacagtgcttccattgtgagccttgaagctcactgaacccaagacggatggcaggtggaagctctgctaaggagaggcccttcttacgcctctttctggggaacctgagcatgttagtgccttttaggtaatgttacttgtgcagcctaactgaaggatgaagtcctccagcttaccaccctagcccaccctggcttgccccgaactaaagatttatgtcactcattcaatcttctgggtctacaaaaccaggagaatggaagagaaatactaaaatgcagttgtctagcagccgtactccaattattagtcattagacctgcatgtgagatttagttacctcttcagttgttaattaacatcactacttcggggagtgcagagtcagggcttgattttctgcaggataaggggaacagatctgtgctgggggaagagctgagttgcagacaactcacaaaggccactgtgactagtattcctttctggcaaacatt

SEQ ID NO: 383864 - DNA, 1193 bp, Homo sapiens
gcccattttatcctgggtgtgagagggaaaagaaatttacatccctttgctttagagtccgtggcttatatgccacggtgccttcagttcactttatatattcatgggtataatttagtagggacgagggagggtgcaggagggaggcaaattgtcctttcttcagtgaatacaggggaacagatggttgttatttgctgagtgattctggaaaatcactaccttgaattctcagttttgagtctgacatttgttctgtcaccatttccccagtaaacaggaataaaaaacgagccacattgacaaggaaaacactgcttggccgagagacaaacattgtcaggatgttggccacgctcccgcgcctttgtgtggtggcgtagctgtcacagtggcgtctgccaggaggtggcaggcgacacctccaaaaccaccccagtgctgaagggcggggctgcgattttttcctggatttaaatcgttgaaaagggaggaaaagaggatggagtgaagtctccctccaccagagagcattttgcaagctgtctgtgctccggggtgttaaagccggagacccatccagattgtcccagaccacctcagaagaaagaacccggagtacaggaagacatgggaacaaaaacggaggcgaaagaggacgaacgggaaatagcaggaaagaccgtcacaacttttccctgtgactgcagcctctgagaaaagcaactctgggcaaagcataggtgtccagatgtgcctggagctcacgctgggtgcccaccggctggcccttcggttcctgcttcggggcagagagcgttgaaatcactctcccctcgccccagccgctggctcctggctgggagcctggtcattaaggtccagaggagaaacagacctctggggacctgccgttcacctgggaccttccgctgcttgccccggggttgacagcaaccccagatgtccgcaccagccacgctgggccacacttagccccacttttgccattctaccacgcacagccctcacacacactccccatccaaggttccagggctctgggctgaaaatcaccagctgtactgcagggcctggggctgccctcttgaccaagctacctctccctcaggagcagagctgacaggctcacctgtttttaagaaaacatgttgccaccttaaaaattccat

SEQ ID NO: 383865 - DNA, 298 bp, Homo sapiens
gcactgcctattgcattcctaaaaactccattccaatgttcaatagaaatggtgaaagtggacattcttatgttgctcctgatcttagggggaaagtattcagtcttcccctgttaaagataatgttagttacaggattttcacagattttatcaggttctcttatattactagttttttgagagtttttataatgaatagatgctagattttgtcatgatttttctgaacctattgaaatgatcatgtatttttgttctttagtctgtgaaaacaaggtattacattagttaatttt

SEQ ID NO: 383866 - DNA, 353 bp, Homo sapiens
ctcttctattaaatgagtgctgttcagattgatttttacagaatatttccaaaattcacagtagttaagaaaatataatttgtaatataatgaagtgcttggctaaaatgaaatccttcttactaaaactgctttctcagaaacagttaatgaacccagattcacttaattgaaatggatcagaatggtttaataatcttggttttaaaaagtttttaaaaatcagctttatgtcttttccttgctatcactgttaaagatagcatgagtctattttatttttataagatttaagatagctttattataaagtgtcctaattagactgaacttcctaaatatcttatataggt

SEQ ID NO: 383867 - DNA, 719 bp, Homo sapiens
gtcttatgcccatgtctggaactggagtgggatcggccacattgaaagaacacagcctgagggcagggaagctattgagccccagagagaagttaaagtacttttcatgaaagatcattgtctgttaagaccccatcgcagagaagttaaagagcttcaatcaccatgctttcagggtcaatttgtctccgaaaaggaacagatggggaagaattattccattcacagttgacttgtcagaaattccaagatcttggactggctgaaagcaatgatgttgccattcatcctttcacgtattcattatggtctacagctgagaagggctatttggggtttgctttgcctgatggtagcagaagaaaaccaagaggcctctctacgaagcttgcagtaaggagaaagttctggagactgggaagagcaacacaaagatattcagttgcttggtgagagctgctctctgcttccaaggcggcaccttgttgctgcattctccaatgggaaggaacgctgggtcctcacatgacagaaggtggaaaggcagagatctgggaacctgatgtgggaagaaatctcatctgtgacgacgattttgtcaggagtcacgggattctatagctgcagcaaacctggagcaaactggtccccaccaatctgggtgagacaaaccaatgatgactgaaaatcacaataaaattgtaatactcgagatctca

SEQ ID NO: 383868 - DNA, 373 bp, Homo sapiens
ggtttcatcatgttagccaggatggtctcgatctcctgaccttgtgatctgcccgctttggcctcccaaagtgctgggattacaggcatgagccacagcgctcggcttgttttatgggttaacagtaattagaatatttaatgaattctggattttaacaacagatataaggtaataaaaaggaatatgacccttttaacttaaaaaagcatgaaagtctgcagtctaataagaagcattttttttctgtaaagaccaaatctgcaaatcatgaacaatttagatattatagtttctttcctagagggggaattttactcacatatccttttgtcttttcttgaggagattttgcagttaacttattttagtt

SEQ ID NO: 383869 - DNA, 439 bp, Homo sapiens
gcttcctactgtggttggattaagaccaagacccttgcgtggcttataaggtctgcaggttttggctctgccaacctgtctagcctcctggccctctcaatcagcttgctgtttccctcatttgttacacaagtttcatttttaaaaatgcatcatgggctgtttcctcctcctggaacattcttccctccctttcccctgacctgtcaatttctattatccttcatttccctgcttaaatgtcactgtttttgaggaagccttcaaatccccagattaggtcagaatcccctaacacactcactcttttcgcaccccatacttaatttttgtattatttttctccaagtgaacttaaataaccatataactgattaaaattgttctcccctgccagaacaagacccatgaggacaggagacccttttgtcatggcttc

SEQ ID NO: 383870 - DNA, 584 bp, Homo sapiens
cttgctctgttgcccaggctggagtaaagtggcaccatcccggctcactgcaacatctgcctcccgtgttcaagcgattcttctccctcagcctcccgtgtagctgggataatagacgtgcgtcaccatgcccagctaacttttgtatttttagtagagacggggtttcaccatgttggccgggctggtctcgaactcccgacctcgggtgatccacctgcctcagcctcccaaagtgctaggattacaggtgtgagccaccatgcctggcacatcatcactttgattatagccatcctgctgggtgtgaagtagtagttcattgtgattttgatttgaatttccctgttggctaatgttgagctttatttcatgtggttgaaataccatgctggccatttgtgtatctttgaagaactatctgttcagatcctctgcccttttaaaatgggttgtctttttattattgagttgtaagagttctttatatattctgattacagatcctttttcagacgtatggtttacaaatagtctttttttaagcttggcactcttgtctagatcataccttcgtctctatt

SEQ ID NO: 383871 - DNA, 461 bp, Homo sapiens
gtgtaaactaattacatatcctaaagcttttttttcttttaagagggggtagttttactctgtgctttcttggagcactgaatgattgctctcataatgtagtctctgcaggttaagtatcaattcactctcctaagcaatacctcacaggccattccctattccaaaccatgggctcatggaaggggtttgctgcctgatactacaagagaaacttaagctccttgtcatcatcctctatgaaataaacctgctaactcacctaaacattgtacttcattcacagacaaactagtgaaaactgtttttagggagctactgttaaagctgtcggagcatttgatttaagggtctcagtaaagttatgttttttcagggtggggggttacagatagcttatttaagtagacaaacatctcaaaatccacaaattagggaaattcctttctgggaagaggcag

SEQ ID NO: 383872 - DNA, 361 bp, Homo sapiens
gtttagaaatagataatgccaagttgctttcttgaaagtttaaaccaatttatttttatcggcaatttattagtgccctttccttacatcccctcctgaaattgtgttgattagtttttttacatacctcagtagaaatatgaagatatgtttctgactcctggtgagtttatatgtcttttcattcatatgtttgttggccatttgtatgtgctcctataaagttcttttcccatctgggaggttctcagtttttcttgttagttttaaagctgtttctatagtttagatgttttctactatttgtattgtaaatatctttatccaaatttatattttgctcattgacattgttgatgat

SEQ ID NO: 383873 - DNA, 343 bp, Homo sapiens
gtcttactatggtgcctgggctggtctcaaactcctggcctcaagtgatccgcccatctcagcctcccaaagcgttgggattacacatgtgagccaacatgcccagccttgcccagaagaatggaaagcagggtcttgaagagatattaacacacccatgtttacagcaccactatacacagtaaccaaaggtggaaacaacccacatgtatacccacagatgaatggataaaaacaatgccggccatccacacgatggaatagtattcagccttgaaaaggaaagggatgctgacacgagctatgacaacatgctgaatgaaatgcagcagacacaaaagga

SEQ ID NO: 383874 - DNA, 761 bp, Homo sapiens
ttcggtgtttagccttgtgccgggtctagggaatggaggtgggcttctaagatggcataggttttgggtttctcaacttacctacagactttttgcatcattttttccttttttttttttcttttttagataggatctcactctgttgctaaggctggagtacagtggtgcaatcacggttcactgtagtcttgattgcctgggctcaagtgatcctccctgctcagcctccctagtagctgggaccacagatatgtgccaccatgcctggctagtttttctttctttattttgtaaaacagagatctcactatgttgcccaggctggtctcgcattcctgggctcaagcgatcctcctgccttggcgtcccaaatttctgggattacaggcatgagccactgcacttggctttttttttttccttaatcatgctctttgtggagttgtcccttgcatatcactttgcccctctcactcattacttctgacttgggtcctgttcatactgcatcttgctaaataattttataagccttataaccaagtagacattctctccctaatgcaaatatatagcccctctatgttctagaactcacaacaagaaaacagagttgctaaaagataaataggagatgctttaaaaagttagagacccaccaggagattgagaccattctggctaacacagtgaaaccccgtctctactaaaaaatacaaaaaaaaaaattagcgtggtggtgggcacctgtagtccca

SEQ ID NO: 383875 - DNA, 401 bp, Homo sapiens
actggtggggttcttgtcgctgttgttttgatttttaagagacatggtcttgctttgttatccagccacaatgcctggcttaggtcaactaatttttgacaaaggtgcaaaggcaatttgatgggaagatgatagtctctacaacaaatgatactaaaataattgaattccatccacaaaaaaggggggtttagatctttatctcaagccataagtgaaacaaattaatttggtcagctacagcggctcacacctgtaatcccagcactctggaaggccaaggtgggcagattgcttgagtccaggactttgaggccagcctggacaacacggtgaaaccctgtctctacaaaaaaaatacaaaaactttgctgggcatagtggtacacatacatagctgg

SEQ ID NO: 383876 - DNA, 321 bp, Homo sapiens
aatctttctgagttttttgcagtatgtaccacctttacaatgaggaaggaaaaagtagcacaattttaaataggaagcagtagtttgtcatttataagggacatatcctacatcctttacgttcttaattcctggcagatacctctttggcttattacttaccacataagatatgtattcaaaggtggtaaagaaaatccacgtcgggtgcagtggctcacgcctgtaatcccagtactttgggaggctgacgcaggaggaccgcttgagctcaggagttcaagaccagcctgagcaccatagtgagacctcatctctact

SEQ ID NO: 383877 - DNA, 334 bp, Homo sapiens
tcccacgccccagtaaatgctgattcaagcattgtttttaagagggagaaggaagagaagagctttaaaaataatgttagagaaggtgtgcctgaaggggaaaagtatgatgagaatttcgggaaaatcaaactgggctgcaacttccttcattatttgctgagcttgaagactggtgttgctcaagcccatttaaaaaatgtcctattactggctgggcatggtggctcacgcctgtaatcttagcactttgggaggctgaggtgggtggatcacctgaggtcaggagttcgagaccagcctggccaacatggtgaaactctgtctttactaa

SEQ ID NO: 383878 - DNA, 142 bp, Homo sapiens
ggaagaactggagggtttccccttagaatagagaagggcctgttcttctaacacttctgaaatagctggcttttgacttagattgagccccaaaatttggagctctttttcattttacacacaaaaactagctgcagaaaaa

SEQ ID NO: 383879 - DNA, 529 bp, Homo sapiens
  misc_feature (526)..(526): n is a, c, g, or t
  misc_feature (528)..(528): n is a, c, g, or t
atgcagttacctagtcttgtggttctgccttgacattctctctcaaatgtacccacttttctccatgcctctgccatggtcccagtccaggcatgcaccctcaagctcctgaactatcccaacaccatccttactagccatctgcatccttttgatttctctccatttattatctacactgcaggtagggccatacgtaaaccttaccatatcatcttccttccatgacacatcctgtaggatgaagtcatttaatcctttacatgactggctgtgctcagacctagactgcctcacaagctcatccaacacccatctaccttctagtgccactgtttttttttcagttcctcacacgtgctgcactcttgattctggcttttttgcatgtgctgttcccattgcctgaaatactttccctctaccctgtccatctagctaattcttacttaactttcaaatctcagcttcaactgagctttcctgaccctttttgaaaacttaattttgcatcgcagtaaaaaanana

SEQ ID NO: 383880 - DNA, 436 bp, Homo sapiens
tttccattcacatgtatcaactctacctctggtagattatcagctctggagaggagtcatctatttctttgtctcctaaaagtggctatctacgtgatccaaaatatgcagcagaatttgcatatatgtgcatgttaattgagtgtttgtgaaaattgagacttggatgctgaagagaacaggtaggtttctcacccccttgaaaatattccattaaaagccttcccaaataaactcatgttctgctcttgggacaaaataaaaatacttggttacctatgaatctagtactattgtttcagtctctcttcagatttaaagagtgaggttcatcgtctgagcagtttaattacaaacaacctctcttaattcctgtattgctggagctcagagcacactcagatcaagggagacgacgtgccactttgtacagggc

SEQ ID NO: 383881 - DNA, 487 bp, Homo sapiens
tgaaaataagttgtggtgtttttgtgaacctggggtcctaaacacagcttccaaagtctttttatgttagggggtacataaatgcaattgcagtgtctgtaatgaaatgctaatcccatcgcacacacaaaggatctcctaaatgatgagcaagcataacttctgtcagtttactcaagaaaataggtttttggcaacgattagaaaaaacaattcgtaaatatttggctatgttttgtagccccaagacctgctgagtggacataactggaagtgagttgctgtaagaaatctgccagggatgagaggtgatggtggtttgtttggaagatgtgaggccagtatagaatgagtgcaggttccttttgataccgtaagtccattttaaagcacacctagaatctcttgatacctgcccctagatttgctcacttaagccataggtagccagctcattatatgcagtaacggtaagttaggcctttta

SEQ ID NO: 383882 - DNA, 440 bp, Homo sapiens
ataccaacctccttattctgctgcgtctgctgccacctccacctccgcttcagggcttccctctcagctcccgtcctcatcatggtatagagagctttccgtaacaccaggtcccggtcgtgaaacccccacattcctggagccaggaggccagggagaacagaggagagaaaggacatgagaaaagacaagccagaggtgatgcaaactaccacgacccactgggagagcctcctgtctgcacgcagaacagcctccttactcagcggttctgttaattcccctccagccttcttcctgaggcttcccattaaggcaactaggtgaatgaagcagcacatcctgttcttagcaaaacaatagtgggtgaaaatcaagtgcttttcctctctggtgcccttggcaacccattctcaatgttgctggtttgctttgaggac

SEQ ID NO: 383883 - DNA, 874 bp, Homo sapiens
tagctcggtacccccattactttgtcacaggcacaatcacagatggaagccaggtgctgtgggtgccccaaggaggaattgcctcgggtggattagggaagacttcccagctaaggcttggagcacaggtaggagttcatttggtgctaatagtagaagtcgtggccaggtgcagtggctcacgcctgtaatcccagcttgtgctttgggaggccaaggcaggtggatcatttgaggtcaggagttcaagaccagcatggcttacatgctaaaacccagtctctactaaaaatacaaaaaaaaaaaaaaaaatttagccaggtgtggtggcgggcacctgtaatccaagctactcaggaggctgaggcaggagaatcgcttgaacccgggaggcagaagttgcagtgagctgagatcataccattgtacttcagcctgggcaacaagagaggggaaatccgtccaaaaaaaaaaaaagaaaaaaaagtagaaatagaaggcaatagtagaaggtattccagcagagggaacggcatttgaaaaggcttggcctcctcaggggacgtcaagtacttggttagggctagggcacaggcaagccactgtaactctgccacttgctagttctttggtatctgaataaacacacctattgatttttatcatatgttctatgccctgagaaaagcgtgaccagttcacatgagccagccaaccttccttcctcccttcctgccctcctttcctttttccctccttctctttcctttcttcctcctctccctcctgccttccatttccctccctccctgcactggggacaggtgggtgttgtgagagcaggatggtactgtgacaaagtgcatggggacca

SEQ ID NO: 383884 - DNA, 2604 bp, Homo sapiens
gagctatacgatcggctcggaccctgcgtccatcagagagaccatatgagcacagaactaaacactcagtgaatgattcatttcctgttgtatttcctgctctggggaagacttacagtgagcaccagaacttaatgttgctccagaaatatattgctgctctgtcgttgttttccaggaaggggaagaataagtgggcactggaacttaatcctgaccttttagttgtttctaggccagggaaaggctccacacaagaacctgggcttaatgaaaactctgaccagggaattgaggccttcctgtgaattgtgccccctgtggcactatggccccagcctgtctctttatcatggcatccctgctgatgggagcaagctgcgcagtcttctcccatcagcctccctgttccctccctgtcccagaccgtgggagttaaaacaaacactacccagggttgattgtcagtgggaaccactcactgtttccccagtccaaggaacggaaacaaagtgagcaggcagatgctaggtgaggccacaccacgaggggccagccccagacacaggaatctaaccagatagttggcttagggttaagggccttttagattctaaagtttcacagtagaaaggatgtcggggtctcaattccaagccctgtctaggaaggaagcccccctgcagcctcctgatggcttgatggtatctggcacctgactgtacatacccccactcctactccagataggtgacacacttccaacactgtgaattgctcagcccaaagggcatctgacttcacactgagctgagcctatcctgtgtccctggacttgcccgttggtgccagctctgctttgaggatccacagagcctacctgccctcagacctgccacagcccttcaaagggcaagaggcacaaccatgaccctcaggctagctcttgattccaggccagagacccagtcctttcaattatgctttaatgctttacagaccacagtgtgggaacccgccctcatccctgccaccttctctccaatttttctgtaactcgggagcatgcagtggcaggcctgtgccgaaggacccatccccatctcatctcatgcttgttgcctgccgctatgatataatccctgggcctttggagtttcttccatatcctggtccttggcatctgggctgggggggtccatggacagtgctggacatttcctgattcctggaactcagtcccaggattagggttttctgttccccttggcggtaatcccacgctgattcccataagcagggccagttcttggtcttcttaaaggcagtgctggcctagcagaggccttgctggttgcatctgttctttctggccagagaccttggtgggtaacagctggtgcagcctcacagcccatgtgctcagggcctcagagccatgtgtggtgccagtggccagcaccccatgagatgcaaacatcaggggatccagctaatgcctcattcccccttggggcctggcctagactgggtatgtggggtgtgtgtgtgtgtgtgtgtgtgtgtgtgtgtgtgtgtgtgtgtatttgttcatctatctatccatccatccatccatccatccatccatccagggattcattcattctacatgccaaatgtgggccaggctcaagggacccagagaggagagccctctgggagtccccagtctggtagaggaagcaggagtagacacaatgagagcacattagaaacaggcacaatcacagatggaagccaggtgctgtgggtgccccaaggaggaattgcctcgggtggattagggaagacttcccagctaaggcttggagcacaggtaggagttcatttggtgctaatagtagaagtcgtggccaggtgcagtggctcacgcctgtaatcccagcttgtgctttgggaggccaaggcaggtggatcatttgaggtcaggagttcaagaccagcatggcttacatgctaaaacccagtctctactaaaaatacaaaaaaaaaaaaaaaaatttagccaggtgtggtggcgggcacctgtaatccaagctactcaggaggctgaggcaggagaatcgcttgaacccgggaggcagaagttgcagtgagctgagatcataccattgtacttcagcctgggcaacaagagaggggaaatccgtccaaaaaaaaaaaaagaaaaaaaagtagaaatagaaggcaatagtagaaggtattccagcagagggaacggcatttgaaaaggcttggcctcctcaggggacgtcaagtacttggttagggctagggcacaggcaagccactgtaactctgccacttgctagttctttggtatctgaataaacacacctattgatttttatcatatgttctatgccctgagaaaagcgtgaccagttcacatgagccagccaaccttccttcctcccttcctgccctcctttcctttttccctccttctctttcctttcttcctcctctccctcctgccttccatttccctccctccctgcactggggacaggtgggtgttgtgagagcaggatggtactgtgacaaagtgcatggggacca

SEQ ID NO: 383885 - DNA, 514 bp, Homo sapiens
aatttaggaggacgaaaagtccaaaaacccaatagaaaaatggccaaaaggcatgaacagacaattcagaaagatataaaagtggtctacatatatatgtgtgggtcacacctgtggtctcagctacttgggaggctgaggtgggaggatggcttgaacccaagatgttaatgttaaggctgcagtgagccattttcaccccactgcactccagcctgcctgacaaagagggaccctgtctcaaaaaaagaaaaagaaaaaaaaagcatatatatatataaagatatatataaagagatatatatataaagagatatatatatacacacacacatacataaatgtttaacttcacttagagaaatgcagattaaaattacactgggccaggcacagtggctcacacttgtaatcctagcacttgggaggctgaggtaggtggattgtttaagcccaggagtttgagaccagtgtggacaacatggcgagactcccatctcaaacaaaaaaaaaa

SEQ ID NO: 383886 - DNA, 861 bp, Homo sapiens
aacaacttctggcagaggaacgtggtgacatttcattatgatgtctaaacttagaacttctggagaatttggaaggatacattattcgagaatcatcctttggattcttcaaagccacaggatacattcaatgtcagtaaccatattcttgatccctgtaacatttattggcgtttcgcgtaggtctctgataaatgtttgacgtctttgtgtgtcttcacactttgttatcctgaaactgtgtcatgtagacataaatggtcacagtttgtcttaaaagtctttagggaaaaggtgatactaggcacttggggctaggaaggtcgtgcagagcagagggaaggaaaaaggccccactgctgtcttaccaaatgaatgggaagatttaagatctttcaaagcaagttgagtctagacccttgcccaagttttgtaacatgattttgtctctttccccccttttcatgcagattatccatggagttagcatgcagatagcatggagtttgtctgatagaagttgggctctggtggaagtacggaaattgaatggtcagggaaagatagaatgcaggtttcttagggagtctctattaggtttccagcctgccttcctgggagtggaagagagatgaggttgtgcccttcaaggaggagctttacagagataaagaaactaagccctagaagaggaactctgccagtctatttacaaagcctgcactgaaagctagaccatatactctttggagagggatgatgtgaccagctcatagactagggcctataccatgtaataggtactcaaacttttttaaaataaatgaatcaataaatgaatgtctttatgtaatcgggtca

SEQ ID NO: 383887 - DNA, 249 bp, Homo sapiens
gccccccccccccgtccctgctccttcccccctctccttctcactccccccctatataaagaaactaagccctagaagaggaactctgccagtctatttacaaagcctgcactgaaagctagaccatatactctttggagagggatgatgtgaccagctcatagactagggcctataccatgtaataggtactcaaacttttttaaaataaatgaatcaataaatgaatgtctttatgtaatcgggtca

SEQ ID NO: 383888 - DNA, 865 bp, Homo sapiens
ccaccataatgtggattgagggagggtacaagagtctagagcctgctgaagctaagagatctggcctcttccctccacagcttctcagaggacctaggagtcttgaagggatcccaggcaacaataataacagtaacaaaacctctagtggcaatggttttctctgtaactcctactgtggcttctgtatgtaccttcggctgccaccatgggttattgctcccttatttgagatacaaatggtgctctcaatgacccaaatccagtcccagctacatcttcactcacacaccatgactaaacttcctgactgccactgaaaccccaacttggtgtgaatctgccctggtgagtattaagctggcagcaggaaatgaaatgagctctttggtgcctgctaacggggacaggggcatttggaaaggttggctctcaattctttcggctaatgggaggaaagtgtaaagaatcaacagaagaatggcttctgaacgatccaatctggtttggaaattttccatagtccttacttgcaaggactggaaatttctgtctgggagttcatgacacttgaaccactgcagccacagggtgaagacttgactccgaagctcaaactgttaagctgtttaggccccccattctactccagtggggctgaaacacttctaatctctgactgaagagaaatactaatatgttctccccacaccccccatctctcgctctcgctctctctctctgattatggtctagcaaattctcacaccttccccggagatggaaaaaaatagaagaaacaaagggcttaggtttcagatatattttctttccagctcctgctgcgcttgtggctggcatgtgg

SEQ ID NO: 383889 - DNA, 565 bp, Homo sapiens
gtttttaccagcacaaggccacccaatattcttatttgcaaaaagaggaacccgttcaaattttcccactggcttccacattcatggacattcattctctttcttctcacgattaccacagattgatcgatctatctatggctttttattccctctttgcccttaaagcttttaattcaactatgtagactttgtacttccccccaacccctccacccaaaaccttttaaaaaatctcttctccccctaaggtaaatcttcaattgtaaatgaatgtccttccctaattttaaagtttaatatatggtcattctctaaatttatatcttttctgctcatgaaactgcacattttttacagaagaaaacttgctttaccatttactgagcaatacttatatagaactttatgtgccaagcacttataaataccaatccctttaatcctcataatagtcctattaagtaggtactattagcactctcattttacagagaaataaactgttcaaggacacacagctagtaagtgaggagctgggattcaacccaagcagttggctgga

SEQ ID NO: 383890 - DNA, 353 bp, Homo sapiens
cacccaggcgcacttctgcaccaggcgcacttctcagtggagccacatcttctggcggccccttggcttcctaccagaaggccaacatggacaatgcgcacccaggcgcacttctgtggaatggagtccaattctcagggacagagaaagtgctccggtgtgtcctgctggtggagagcacaatcgtcactggagactggatgagctcagggcaggctgatggattattcaggagaggcttcataggggccaggggcctgagctgggctctccaggggtgcagcctgggcaggggagaaagggagaactctaggaaggggacggtaaaatcatgccagaagtgcgcctgggtg

SEQ ID NO: 383891 - DNA, 2617 bp, Homo sapiens
  misc_feature (2614)..(2614): n is a, c, g, or t
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggagcaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccgtgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 383892 - DNA, 1881 bp, Homo sapiens
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggagcaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattcctggtgacatggctgcaggtatcctctagaacagc

SEQ ID NO: 383893 - DNA, 2688 bp, Homo sapiens
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggagcaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttcttcatacacccctcaccttaatcaaaggattcaggtgttacttctgccctacaaagtctgccttttgcctccctcttcctgttttcccctggactgagaaatgggttgctcaagggaccatttccctttttcttcaagctccttttgatattccctgccccagagctcatgaccagaacccagagctgatttaaaatattttgaaaaatggaggaggcagactgctcccagcagcctgtcaatggctgctcatctgtccatggagatggttacaggcaggtgtagtcaaaatgattgattccttgggtttgggggtgaataggctgggaaatttctgagccttttttttttgtcacagtgccctcaagttgaagtgatgagctggatttctttcttgttccatactgggcggcatgctcctcccatctccaccccttggtttgggggcttccagctcattggcaaaatctctctagttgccttcctttcaagctggagcctgacttttccccaatgtacattttttttttctccacaaagagttccttctctaatgtccccatctggtattaagtgcactttaaagaaaggggcagggtggattttcaagaggtgggaagctctaaggcttgaccgtgaggggtcttctcccagccattctcagcccatatgcagcaccctccatactgaagaggactgttgttttagtttcagacggtcctttccttccacatggtgctaaggtggttttctaggtaactgcagggatggaggtcactagccattccaaaccaggagagaaagtctggtgtcctgatatccagtcttttctaggaggaagaccaagattctccagcggcagggcagcctatcacccaacttctaagtcaggaaaggaagctgagtgggaatgccagctggtaagcgcaggctgcactggcccatgactccttcaaggaaaagaggccctgctccctttacctgctgagctccttttagcagttagggagaactgcagggggaaaaataccagtggagtgtggaataaatccaaagcagtgatttttaaatgtttttcaaaaacaaatcttacatagaaccccaatataaaaaataaagtaatgcagacctgggcagtttgca

SEQ ID NO: 383894 - DNA, 1242 bp, Homo sapiens
  misc_feature (1239)..(1239): n is a, c, g, or t
ggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggagcaagcgccggtaccagcacggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagctgctgagctccttttagcagttagggagaactgcagggggaaaaataccagtggagtgtggaataaatccaaagcagtgatttttaaatgtttttcaaaaacaaatcttacatagaacccccttcctcagaacaatggttttcaaactactccacagaatcctcagggtctcttaggactgttcaagggctcatttgctgaggagcctttgaacagtcagtcctaagagacgctgagacttcttccncca

SEQ ID NO: 383895 - DNA, 1241 bp, Homo sapiens
atgaagtccggtcctggcatccaagccgccatcgacctcacagcgggggccgcaggggggacagcgtgtgtactgactgggcagcccttcgacacaataaaagtgaagatgcagacgttccctgacctgtacaagggcctcaccgactgcttcctgaagacatacgcccaagtgggtctccggggcttctacaagggcaccggcccggcacttatggcctacgtcgccgaaaactcggtcctcttcatgtgctacgggttctgccagcagtttgtcaggaaagtggctggaatggacaagcaggcaaagctgagtgatctccagactgcagccgcggggtccttcgcctctgcatttgctgcactggctctctgccccactgagcttgtgaagtgccggctacagaccatgtatgaaatggagatgtcagggaagatagcaaaaagccataatacaatttggtctgtcgtgaagggtatccttaaaaaggatggccccttgggcttctaccatggactctcgagtactctacttcaagaagtaccgggttatttctttttctttggtggctatgaactgagccgatcgttttttgcgtcagggagatcaaaagatgaactaggccctgtccatttgatgttaagtggtggagttgctggaatttgcctgtggcttgtcgtgttcccagtggattgtattaaatccagaattcaagttctttccatgtatgggaaacaggcaggatttattggtaccctcttaagtgttgtgagaaatgaaggaatagtagccttatattctggactgaaagctactatgattcgagcaatccctgccaatggggcactgtttgtggcctacgaatacagcaggaagatgatgatgaaacagttggaagcatactgaagtgtcttggtgaacctggatccgagtccatgagtttgaggactacagttcatcacagggttcagcagagtacaagaccactgtctaattttgacttcatgggaattttggttttatcttcccttcttctaccctaaatcttaactttatggaagggcctctattttacatcatataatttctgcccataattgtattgaaataggaaagttgctgctcttgcacttgctggaatgtacagggtgggctggttggccctatgtacctaatctgaaaaactaaatatcgttctgtcagggcctttgcataaagccatttgtgtgtacatgcagttt

SEQ ID NO: 383896 - DNA, 468 bp, Homo sapiens
tagagacaggggtttcaccatgttggctaggctggtctcaaactcctgaccctcaagttgatctacccaccttggccctcccaaagtactgggattacagatgttgaagccactgcacctggccctggagaaaagttggagaagattctgatgtctgcactccagcactagaaatcctgatttgatagatctattacaggtgtggcctggacattggcagggttgaaatctccccaggtgattccaatttgcagtcagggtagagacctactgctttaaggtcctctcaaagcctggttctgcctgctcagctggtgggctcaggggagaaggtgagagttttaatggtaatgtccaaggcagcagtgtaacccggcttctgttgtcttacccaccctggttcatgggggtcaaggaaggcatggcccataagggacctgtggtagaggagtcaggcctcctagggcc

SEQ ID NO: 383897 - DNA, 1534 bp, Homo sapiens
  misc_feature (43)..(43): n is a, c, g, or t
  misc_feature (1534)..(1534): n is a, c, g, or t
caggcttaaaaatgaaaagaggaataaaagaaaaactgattgnaagcattagtggctgtacaatctgggggagacaaattctacagaattagtcaaataaagtcactaaacaaataacaacaacaataaaaaccctggaaataacaacttctgggaagaatcagaatccagaattcctataatacgtcatctaaaatatcacttgtaaaacaataacaacaaacaagacgtgcaaagaagcagaaaccctatagctagagaaacaggattgattttaagtgtgtgcatgtccaggggcattgttaaaaaacagtagcaatctgtaaggcaaataaatgaaaatccaacttgcaatactggttgcaagtcacaagtcaacagactagccaaaagtttaacagggagatctagaatgagatagccattgtgtaccttgataagctgccactatccctgttgatctttgttgttctggaaggctacacacataggtgcagctgtgtgcataatctggagacaccagagaaggctttaactaactattcatccatggctgaatatgagacctcataaacttacggaggagatgcaagaaggcatgtcagaaagtaaactgtatcagatttgtaaactgcctgaaggttgaaagtgttctccaacccacaaacagatccattgtcaaagggtagaaatgttactgaatcaagatgtttaagtactgcctctgaccactcaacatgatcactacactatgcttaccaggggtaatctctagaatccaggcttaaaatgaaaagaggagtaaaagaaaaactgattggaaacattagtggctgtgcaatctgggggagacaaattctacagaaatagtcaaacaaagtcactgaacaaaacaacaacaataaaaatcctagaaataatgacaacttctgggaagaatcagaatccagaattcctataatatgttatctaaaatatcacttgtaaaacaacaacaacaaaaaaaacaagatgtgcaaagaagcaggaaaatatgacccatactcagaaaaaaagtagttaaaacatactatatttgacgggtacagatttggacttcgcagaaaaagacttcaaagcagctattataaatctgttcaaaggtgaaagcaaaccatgtttaaaaagtgaatggaaagtattattataataattcactagagaatatcaataaagagatataaattaccaaaaaaaagaaccaaatggaagttctggagttgaaaactacagtaattgaaacaaaaaatttactcaaggggctcaacagcagattcaagatgtcaggagaaagatttagcaaacttgaagatagataaataggacttatccaattggaagaacagaaaacaaatagagaaagatgaacagggcctcagagacctataggacaccattaagcacagcaacatatgtttcatgggagtctcataagcaattgaaagaaagaaagaggggaaagaatatttgaggaaataatgcccaaaaactcacn

SEQ ID NO: 383898 - DNA, 490 bp, Homo sapiens
tcaggggcaccagccaaaccaggaactcgatggaccaccctcatggggccccagagcagcctgagccagggtcagatgggcagaaatgctcctcctctcttctccacttcccccctcctgctctccctggcccgctccctgtcccctgctatcccagtctcatcctggccccctttccctcctaactccgctgtcacttctctcctcttggtccctagaagtgagagtcctgaggcacaggaagagtgagtagctgcgtgcgcggctcctggctgaggctgaggcgcggggtggggggaagaggcaggaaaagcacgggaggagggcccagccttgaggaaagggcaggggcaggggctggcaggcgagagaacctcgatgcatgggtggggccttgtacctcatacctaccctcatacccacatatgcacccaagcattctgcgcctggctgatggttttgcctaaataaatgagtaagccacaccgat

SEQ ID NO: 383899 - DNA, 882 bp, Homo sapiens
ctacatgagtcactgtagaaaggaatggagactgtgactggcttggaccaatagtgttttgctacctgtatgggagtggggctgggttttcctcccctggttactccatgaatggatatctgcacaaaaattggaatggctgctgaaaaggcaaacagcagtgtctgtttcagctcttaattattagctgagtatgcacccctctccagtctcagctcttgctttttttttttttgagtcgtggttgcatattgaacagactgtagttctgaaatgcatcatgctattgctcacttttattctttccttccctttgtctggaattattgccccctccctgccccaacacattgccctctggtccttgcctacctatcgtggttacttttaggtgtcaacttgactgggttgagggatgcctagatggctggtgaagcatcatttctggttgtgtctgtgagtatgttcccaggagagaatgaccttgagtcagtgaactgagagaggaagactcactctttgtgggcaggcacctcccatgggctgggtactggctgggaaaacggggaagaagagggatcctccctttttgctctctcctctccagagcgggacatcttttcttctactgcccctggataccagactccaggttcttcaacttttggactctgggacttgaaccggaggccttccaggtgctctcaggccttctgcctctaacttggaggttgcaccattgacttccctcattctgaggtttctagactgagccacactaatggtttctttggttctccagcttgcaaatggtctattgcggggcttctcttcctctgtaatcatgtaagccaattcctctaataaattctttctacaaaa

SEQ ID NO: 383900 - DNA, 245 bp, Homo sapiens
tgacccagacctctaaataggtaagggtgtgtgtgtgtgtgtgtgtgtgtgtgtgtgtgtgtagaagtgatggcacattaactccaacatataggtactatgggccttttaaatctatataactcttagagcttattaaagttcctttatgtattatctcatgtgattctccccaagagggaagaatgaccattatgtaccatgtaacctcatgttacaggtaggtaactaatactgagagaagt

SEQ ID NO: 383901 - DNA, 419 bp, Homo sapiens
cccaggatctctctattgtttcttactgattatgtatctgcaatgattgcaaaataaaaaggtttaatttttaaaaaggattaaacattacatagcatacacttgagtaaaagacaaaatctggctaaggattatttttgtcctaagtaatatgtggattttgtacaacataaatcacaatcccctaaaatctatattgtaaattgataaaatgtaaaacctgtgtattacagaataaaagatgaacaaaaattacaaaacactaagaaataccctagtgccccaatgtatcagtagacaaacacatggacagatagtttgcaaaaggggaagtacatatggtgaataaacattatgagatgtctaatattgttagctatcaatgaaacatgaaataaaatgatgacattgcacacatc

SEQ ID NO: 383902 - DNA, 249 bp, Homo sapiens
tgtgtaaggcttgtccttatacagtggggtctcgctatgttgcccaggctggtcccgaacttctgggctcagaggatctgctggcatcagcctcacaaagtgctgggattacaggtgtcagccaccgtgcctggcccaggcctttccttttgaatgaatgaatggcttcatcccaaagaaacagttggatcctacatctaggaagataggtacccatgtgtgttccatggaaacaccacagctcatgat

SEQ ID NO: 383903 - DNA, 1502 bp, Homo sapiens
acgcgggttaatgaaataaattgtctactatatataggttttgtgtgaacatacaaatgaaatgtactgtctcagaataatgtggttggggaaatatctggagacaaatacaatgcaattgcaacataacagttacacaccagactcttaacaggaataatgtagtgtgatacttgaaagcctaaactctgaaatgagattgcctgagctgagatctcaattcctctaactatgtaaccctgggcgagttacttcaaagtgcctccgttttcttctctgcaaaataaccattgatttgaaatgtggaggattttgaaacctaagctaagaaatgtgggtttgatatgctgaaaaatagggagctacttaaaatttttgaacaagcaagtcacatgatgaaattaattgaggaacattgtatttgtgattgcatatggatggagtgggaggacctagaggcaaagacattagataggagaccaccagaacaaactagacgtgaaaggtgcagctgtggaaatggaaagagatgggcaaaaccaaaaatcaccacagagaaaaaaaatcatccagatttcatgatagattggatgtattttgaaacacctctctccatacaaatgaaataattcagcaaaattctagaaaatgctggtgtaggagctcagtggaaatctcccgtaagtgctgtgagaaattataaattctggggactccagctgatacagtgtgcattcacttacagcttcctttgcccctttgtacactagagcacaacaggaaatattggcttatctctgtaggaagtgtctctataggagttgcttactgaactgaatatctttgtttagaactaattgacctttctaaaacagcatttttaaagagcttactcaaataaggcagactttaaccatctgataagtcagagacaaatcagtcctcttctaagcaaggttgacagtcagtgcaagagaaaagaaagcacagaaagaaaggcaccatcagacaaaagaacagtgtattagtaaaaaccagataattaagaaaattttatttaatgtgaacattgaattctaacacaaatccttttcctgcattatgatagtatctgtgtgaaccaaccttttttcagccctttttgttatggaatgttaagaatgttagtttacaaggttataaagtagaagagtctaattagaaaccagaaaatatctcagtcttttggtctgaatttgttttcctttggttagattcttaaagtagaaaaaaaaaaaactactacttattttgtaaacattttgaggattttgattcagatattttaaattattatgagagataaagaataaccctgtccaaaaaagtaagaaaatgaataaaatttgtttaaaagaggattctcttaaaatataaccaaagggacagattttgacagcagtcttcattgttgttccatatgagtgttttctaaacctaacagatgtaagcaataaataagt

SEQ ID NO: 383904 - DNA, 356 bp, Homo sapiens
ccctataatagtcccgtgaatagggctagcagtgggatttttgtgttataggcgaggaaataaacactccttttgctgagactaaagagccaggttggggtctctggacacatagtgcaatcaagggaggcttaagacagcagaggccctcagagaagacgttcattctcccagctacttgctaagcacgtgccatgtgatctgggcagtcctgggcacaccagtggtgaaaatacatggtcctgcctgcctgcctggagcttctatttttctgatgggagaatgctgctccattttgttattggaggaacttgtgcagcaaagcctgttggggaaaatggcgggctagaaacctg

SEQ ID NO: 383905 - DNA, 770 bp, Homo sapiens
ggatgctaaaaccacccctatgaaccttgttttctgttgaattgtgtttcccaagaagataatattgcagtcttgatccccaatatttgcaaatatgaccttatttagaaatagggtctttgcagatgtaatcaagaagagggcctactcgtcctaacccaatgactggtatccttataagaagaagaaatttggatgcagagacacaccagagaatgtcctgggatgacagaggcaaagattaaagtggagcatctacaagccaaggaacaccaaggattgctagaggtcaccaaaatctaagagagaggcatggaacagattctctcggtgcctccagaaggatcaatcctgccgacacctagatttcagacttctaatctccagaactgtgagagaatcaatttctgttgttgtgagccactcagtttgcagtaatagtatccctaggaaactcacacacctctgtggatgctggccttgtcctgggctcctccacatgtctcacagccacacacaaggccatcaactcagacatggtggccaggattctcctagtcttgcaaactgaggctgcaggtcagagaatctctcctgctttttgggtatagggaataaaattatcatgcctgggcgttatcaggtctcatttgacttgcttctacatgagatctttctgtatagtgtgatattagaggaactccctggacttaggagcccaaatgttcatgatgagtcaggctttgggttgagagcccaggctttggggt

SEQ ID NO: 383906 - DNA, 479 bp, Homo sapiens
ggtataatcacccagattacatttctctatgagaaacattcacctcgcattttgaaaagcatagaaaaattcactgccaaggactagctggccaacagtagccctagggagatatatttccgttctcccacccagcctctctgcacccatcctcacaatgacatacaccatagtggaagtaacatatgacttatggtgggaaaaaaaataacaaatgataaaatgggaaggagggcaaggggaaaatagagagactgctaccccaccacctgaatggaaggggaccccagcacaaggaggaggcttcagctacactgcacacatgtcccccgggtgtctgaacctgccagaaatctcttagtccattttcctctggttgatagcactgcagagaaattgtttaatgtgtgtctagggtattgttcattgaggaaaagttcagggaatagactattagaattcattaatctccactcaaa

SEQ ID NO: 383907 - DNA, 480 bp, Homo sapiens
gattagctaaatgcagatggccaccgtgagcccttctccagggcacgggtgaggcgacagcaagtagcatcggtctgcaaggtggcgttatctagaagttgtgttcttgtcgtttctctttactggtgcacatcacagagctggagggacacagctggataatcctgggtccagactcagagccttaagctccttttacttatttttttaataacaaagaggaatctcatgttttgctccaacgaacgacataaaggagaagtagtgcatattttaggaactttgtgtcccagataccaaaaagattttgtaccatccttagaataagcagatagacaccatctccccagcccacaaggtcacagctttgaaggttatacgtgtgtttggatgtttacgatcccatttccaggacctttgcactttttatttctcctttccgggaatgctctttccccacatcttggcagcctcccgctc

SEQ ID NO: 383908 - DNA, 159 bp, Homo sapiens
agtgaggtgtgtccacgtcatagcctgggccccgggggattgactgcatcacagggcaggcatttagagggaaccttggccatcactcactcctaattttaatgacatgcattagctaaattgtgttctgagtattcattcggcgctgtttatggtgtg

SEQ ID NO: 383909 - DNA, 742 bp, Homo sapiens
taccagctgatattttctttcctcaggaccagctgttcaggagcatcccggacgagagccaggcacatttgagacttggatccaactaaagaccgccgcagattcttctgcagcaatgtcggtgttagaagaaaatcggccgtttgctcaacaattatccaatgtctactttacaatactttcgctgttctgttttaagctttttgtgaaaatcagccttgccatcctcagtcatttctacatagtgaaaggcaaccgcaaggaagcggcaaggatagcagctgaattttatggagtaacccaaggacaaggttcctgggcagatcgatcaccactacatgaagcagcaagtcaaggtcgccttcttgctctgagaacattattatcacaggtaatatattacatatagtttaaaatataccccctttccatgtgcacagaacatggtcaaaaccaatcaatgcaaatatgataaaaccacttacattttacttctgcccttttattttaactcatgtcagagaagtcaatagtttctcacttatctttgaaacttcttttataaatattttgatataattgtatgtcttagtatttcagatttctcagacagcatatttgttcatcgatagacatttaaagaagtaatgattggatttatgtgttattgattgagctttctaaatatgcttaactctgcacaatatgtgcagctaattacagacttagttcaataataaca

SEQ ID NO: 383910 - DNA, 526 bp, Homo sapiens
cagacattcagcagatctgctctcccaatcagggagagcagagagtcccactaagactgcaggttggaataaagaacagcagggttcctgggcagatcgatcaccactacatgaagcagcaagtcaaggtcgccttcttgctctgagaacattattatcacagggttataatgtaaatgcagtaaccttagaccatgtcaccccattgcacgaagcctgccttggagatcacgtggcatgtgccagaactctgctggaagcaggagctaatgtaaatgcaatcacgatagatggcgtgactccgttattcaacgcatgctcccaaggcagtccaagctgtgcagagctgcttctggagtatggtgccaaagcccagctggagtcatgtcttccatccccaacgcatgaggccgccagtaaaggtcaccatgaatgtcttgacatcctgatatcctggggcatagatgttgaccaagaaattcctcatttgggagactcctctctatgtagcttgtatgtcacagca

SEQ ID NO: 383911 - DNA, 754 bp, Homo sapiens
taccagctgatattttctttcctcaggaccagctgttcaggagcatcccggacgagagccaggcacatttgagacttggatccaactaaagaccgccgcagattcttctgcagcaatgtcggtgttagaagaaaatcggccgtttgctcaacaattatccaatgtctactttacaatactttcgctgttctgttttaagctttttgtgaaaatcagccttgccatcctcagtcatttctacatagtgaaaggcaaccgcaaggaagcggcaaggatagcagctgaattttatggagtaacccaaggacaaggttcctgggcagatcgatcaccactacatgaagcagcaagtcaaggtcgccttcttgctctgagaacattattatcacagggttataatgtaaatgcagtaaccttagaccatgtcaccccattgcacgaagcctgccttggagatcacgtggcatgtgccagaactctgctggaagcaggagctaatgtaaatgcaatcacgatagatggcgtgactccgttattcaacgcatgctcccaaggcagtccaagctgtgcagagctgcttctggagtatggtgccaaagcccagctggagtcatgtcttccatccccaacgcatgaggccgccagtaaaggtcaccatgaatgtcttgacatcctgatatcctggggcatagatgttgaccaagaaattcctcatttgggagactcctctctatgtagcttgtatgtcacagca

SEQ ID NO: 383912 - DNA, 435 bp, Homo sapiens
agtaaatggcagatatacatatatgtatgtgtatatatatatacacatacatatatatacacacacactcacacacacacacaagttaattgagggaaatgaagggagtatttagaacagagttaacagaaaccaacatgaggtggaggaaccctctgagctatcaacagtgaggaacagttgtctaggcctgaaacaacaacgggaaggggaagttactagaacctactgtagccatggaatgggtcaccttgtaggacctgtgtcttttaatagaagaatgaagctactgcttacctgcagcctggcggaaaggaatctggggtaattaatataaacttgctttccttctgttttccagtttcctttttgtggaaactgttggaccaacccagccagaagggtagagcccagttaatgcaactcgtagggtat

SEQ ID NO: 383913 - DNA, 446 bp, Homo sapiens
tttaagattcttccactaatggacttgtattcaagacagcttttcaacttactacatacctttggacattcttttctgtttttttgagacggagttttgcactccagcctgggtgacagagcaagactccgtctcaaaaaaaaaaaaattttaggctaggcacggtggctcgcacctgtaatcgcagcactttgcaaagccagggcaggaggatcacttgagcccaggagttcgagaccaccctgagcaatgtacaagacctgccccccaatctaagctaattacaaaaaatgtaattagctgggtgtggtggcacatgtgtaatcgcagctactccagaagccgaggtgttagaatcgcttgagcccaggagtttgaggttgcagtgagccatgatcatgccactgcacttcacactgggcaacagagcaagaccttgtctcaaa

SEQ ID NO: 383914 - DNA, 457 bp, Homo sapiens
ccaagatgctggctctggccactggaagtcaaactgggtgcacagaccagtgagagggcatgagggagcctagcaggggtgaacagcaaccctcagcctccccacagccctgcctctcctcctgcctctcctcggtctcctttgaggattcagcctctcgtcctcaccacttatggtctgagggcctccaggctcctcttctggctgtctacccctccacacccatagctccagtcatcacttccacagggatgactcagaagttccctctccgggagacccgtcccttacaggccacatccagtagcgctccagccattcagcagctccgcctggacgtcaagggcatgtccaaaaccgcgctcatgatcttcctactcccccatccctgagatttatcctgtggctgtggtgtcctgtggctactgtaacaaatgaccacaaacttggtggcttc

SEQ ID NO: 383915 - DNA, 485 bp, Homo sapiens
agaaagaaagtactgcctgagttcttttttaaacttcagagtttattttctcaagaaattgtatgttcccactctccacttcccctctccctgctgaggaatcatctaaagacattctcaagcttgtccaagccaccttattttgttgttgttgttgcagttctgttgttttgttttaggcttttagcagcctgaagccatggtttttagtttctgtctccagtgatgaaaggaaaagagggatgaggaaggggctttaccagcccaatcacaaatagaaactaggaacctatgactatattctctcccttggacacctaaccggtttacttaacaatatttgcaggattagctggatgcagtgtcgcatgcctgtagccccacctactctagaggctgaggtggagggctttttgcaggggttcgagtctgggctgggcaatataaggagaacccccccccccaccaccctgcatctgaaagag

SEQ ID NO: 383916 - DNA, 377 bp, Homo sapiens
ataataaataaataaaagaaagttcttgcctttgattctatgcagtaactgactgtattttgatgtcatgaattatacttgttaaatatttgagttatattttttaaaaaaagttttttcagctgtaatttatatatcatgaaattcacccattttagatgtataattcaatgatttttagtaaacttacagaattgtgcaatcatcactacaatctaagtttagaacctttatttccttcaccccggaaagaaaccgtgtgtccatttgctgtcactctccattccctcccctcagccttaggcaaccaataatctacttcctgtccccatggatttgccttttttgaacattttatataaatggaatcatacaat

SEQ ID NO: 383917 - DNA, 2036 bp, Homo sapiens
atcatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctc

SEQ ID NO: 383918 - DNA, 1076 bp, Homo sapiens
atcatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgc

SEQ ID NO: 383919 - DNA, 1677 bp, Homo sapiens
ttaatcggcacgaggcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctc

SEQ ID NO: 383920 - DNA, 2385 bp, Homo sapiens
  misc_feature (230)..(230): n is a, c, g, or t
  misc_feature (235)..(235): n is a, c, g, or t
  misc_feature (245)..(245): n is a, c, g, or t
  misc_feature (252)..(252): n is a, c, g, or t
  misc_feature (254)..(254): n is a, c, g, or t
  misc_feature (267)..(267): n is a, c, g, or t
  misc_feature (280)..(280): n is a, c, g, or t
  misc_feature (284)..(284): n is a, c, g, or t
  misc_feature (289)..(289): n is a, c, g, or t
  misc_feature (292)..(292): n is a, c, g, or t
  misc_feature (297)..(297): n is a, c, g, or t
  misc_feature (306)..(306): n is a, c, g, or t
  misc_feature (333)..(333): n is a, c, g, or t
tccgagcgtccccgtggcggtgcgtgccccgagggacttggtgtctgccccccctccctgctgcgaggtttcccgccccgtcgtggcgccgccttcccgcgttcgtccgtccctctgaggttagtcttcagttagcgccgccggttgccccctttttcagagttgaccacaccagggtaatagtgtgcgtccatcgctacaattcgttacaaggccctgagccgggccancttancactttgatncaggttnanaagaattcttcancgttttattcgcnacantcttnttnctgcnatgactccnctcctttgtcttcttatgtttcttgcnaaataattacttccgcatccgccatgttaccctgcccgcgtgcgtccgcccggtccacaccgagggaacgaccgcagactcccccgccttgtcccgtcgtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctc

SEQ ID NO: 383921 - DNA, 1472 bp, Homo sapiens
atcatctcccggcaggctgcggaagggggtcgagtagaaggaccgccgctccggcctcccgcgacttctcgaaggtgggcaggtcccaccttgtggaggatggaggtgaccggggacgccggggtaccagaatctggcgagatccggactctaaagccgtgtctgctgcgccgcaactacagccgcgaacagcacggcgtggccgcctcctgcctcgaagacctgaggagcaaggcctgtgacattctggccattgataagtccctgacaccagtcaccctggtcctggcagaggatggcaccatagtggatgatgacgattactttctgtgtctaccttccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggaggtgggcggaaaccagggtcactgagctacagaggaggacatgccctgggatgtagtagtatcatgcagaggtgtgtgggcccttttgttcacctctgcagactgtgaatcctagctgccagtttgcctattatatgccaaggcatttgcaaaaatctcattaatctaaatcaaaatagctttaaagaaaaatgcatacacttcctcagatcatcaaacagactctggtccaaggttggtaatgaaatgactgttcctgacagggaggaatagcagggcccaatcttctgagatggcttctgggtctttccatggtcagagaagatctatagtccgtcctgaggtctgtcaatgtcacaggaaaaggcaaacttgaggggatcgtcgcctgctggctaagaccagggagctaaaaacttgaggaagggaacctgcctgggtgggtgctacttctgattcattgtccttgtccctgtcataagtacctccctattgtagatagaagggaaggaaactgttgacttgagcttggctaaatttcctgaaggtggaggaccttagagttgctccaagtaaactttccaaggactt

SEQ ID NO: 383922 - DNA, 1733 bp, Homo sapiens
  misc_feature (23)..(23): n is a, c, g, or t
atatggcatggtgaggccgggtnggaatcggccgaggccaatactaagtttgtggcattggctagtaatgagaaatgggcatacaacaattcagatggaggtacagcttggatttcccaagagtcctttgatgtagatgaaacagacagcggggcagggttgaagtggaagaatgtggccaggcagctgaaagaagatctgtccagcatcatcctcctatcagaggaggacctccagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaagagtccaaagctgcctttggtgaggaggtggatgcagtagacacgggtatcagcagagagacctcctcggacgttgcgctggcgagccacatccttactgcactgagggagaagcaggctccagagctgagcttatctagtcaggatttggagttggttaccaaggaagaccccaaagcactggctgttgccttgaactgggacataaagaagacggagactgttcaggaggcctgtgagcgggagctcgccctgcgcctgcagcagacgcagagcttgcattctctccggagcatctcagcaagcaaggcctcaccacctggtgacctgcagaatcctaagcgagccagacaggatcccacatagcagcagcgggaagtgtgccaaggaagctctgtggcgttgtgttattggtagacaccctcagcctcatcatttgactacctatgtactactctaccccctgccttagagcaccttccagagaagctattccaggtctcaacatacgccgttccaccaattttttttttagccccaccagcttcaggacttctgccaattttgaatgatatagctgcaccaacaatatcccgcctcctctaattacatatgatgttctctgttcaaaagtaattggcagtgattggccaggcgcagtggctcacgcctgtaatcccagcactgggaggccgaggggggcggatcgtgaagtcaggagatcgagaccatcctggctaacatggtgaaaccctgtctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctc

SEQ ID NO: 383923 - DNA, 255 bp, Homo sapiens
tcagaaagtccctgtagatttctaagcgtctgtgtttgtttgttagatgcttgttgacgctccctgctcagacctggctcaggaactacgtcagagttgtgccaccgtccagcggctgcagcacacactccaacaggtgcttgaccaaagagaggaagtgcgtcagtccaagcagctcctgcagctgtacctccaggctttggagaaagagggcagcctcttgtcaaagcaggaaggtaggactctctgcaggca

SEQ ID NO: 383924 - DNA, 400 bp, Homo sapiens
tctatgccctcttccttcccaaattgttatctccaactggaaagacagatgaaaattcaagataggtctccatgtgccagtttgtgcaggatttcaaagccacttcaggtgtaatccctatttcttcgaggaacgttaagtggcctgaaaattgaaggagaaaaaagatggaatatctcctcaagcgtacagatgaagacagccaggtgaccttgagaaagttactttacctctttgtcttgctttctttctctatgaaatgaaaatcatgtgtaatgaaataaaacacataggaaacaaatgcttaattatgtttgtgcattaatgaagctgagttgacttatttcatgggtgtgtacattttgagaggtgacaacgtgctagcagccctggctcgctc

SEQ ID NO: 383925 - DNA, 514 bp, Homo sapiens
tattttatggatgaagaagataacaattatgtcagttttagaaactcattctcagctatctacttcccactcttaaaagtttttcttgaaaacacaactaaaaagagagatgagatgaggctttactgaagaaaagttggttaggaagagattttgatttaggtaaataagaatagtttagaaaccaggctagacttcagacagctcccaggcccaaggatgggaatgagggtagttgttagtctatttagcctcttctcacttggttttcaatttgctatccagtcgtctttcgcagcagggttgacccttcattgctttttggatggcaccgtccacagacaggctcttttgccaagtcctgtcaccctcacatgtgtatatttcttttatcttctttaggaggtaggtaggtctacttgaagccagaagactctaactcaacatctggtataagaagatgcagtagaaattctgtgtatccagctagcttaaacctatgtatttttattag

SEQ ID NO: 383926 - DNA, 489 bp, Homo sapiens
taccaataatctgtttcatggccatacatgtcttctctaagatggtagatgctttctctcacacattgcacttccttgtggatcctcaccagaactacatttgacatccatatttctaccaacagtctcttcagggcaatgtaggtgtttccctatcatgtgtctcagaactcttccagcttctaccattgcccagttccaaagccacttctacatttttaggtgtttgttacagccacattccatttcatggtatcaaaatctttatcagggccagcaaaacaaaaccagcaggagagatttgtataggataggatttaagggaactgggcttacgtgattgtggaggctggcaggtttgaaattttgtagggcaggcaggcaggctggaaagccttgggctgctggctgaagctggcagtttcacaggcgggattttctttccccgggaaaacccgttttgctcagttttgaaggctttcaactgat

SEQ ID NO: 383927 - DNA, 360 bp, Homo sapiens
gcaccttgcatctgatagaggcttgtaagagcagattgacaggtgaatgtcacaggtccataagaaggacaaatagatctaagttgggcaaaagattctatttgttggttctcccttctaagatgataatatgcccctgcacttgagaccttacttgaaacttaaagaaatgtgattggttatggtgctgggagaaaggggtgcacctgggaggacactgagaaagataaacaaaggggaaggaagagaggacaacctgtaacttttagaaaaggctactacttttaactgttggagaaaatgctattgcttgcactcacaatgtcaatatacattattcaggaactttaagtcctggag

SEQ ID NO: 383928 - DNA, 452 bp, Homo sapiens
tgtcctcacagctggccctagtcccatgtggaagtgggttagaggatgatgatgtttgtagcatgctggagtttggagtctccatgccatgggcacactcttccatactgttgccctcactctgacttcttcaccctcacgtcactcccttgctgctgttgagtgcctagaagggacctttccatgatggctatggtgggagcgagggatgttttgccgtgaaattgccttgaaaataaaatagtgggttctatcactgtaaatactcagctttctttggacaaaggacattgtctttgaacagatggagaatattgaagaaaaaagatgtctctaccatcaaattctggacacttgagtgaaacagttgaataaaaagaactcagagcattgctttttttttgagacgaggctcactctgttgtttgggctggagtgcagtgacacgatca

SEQ ID NO: 383929 - DNA, 393 bp, Homo sapiens
atctgagatactttgtcctcatgaataaattagttagtagaatctaatttctagatccttcataatggtaattgagggtaaaaaataataatgtagtagtcaattttagccctttaaacctatggggaactgtatgaataactgtttgaaactgcagggtaatcctgtcacacttgcaaacacatagaagcaacaagactatttcctctcacacttttaattaaaatagtgcctgagtagacttccagggtaaggatcagaaattttctttctaatttccctgttttaatgaccactacttttaaagctatgctggaattcactttcacatatatctaacttacagaaaattttgaagagcctaaatgtctatggtagattcaatgtttcctt

SEQ ID NO: 383930 - DNA, 347 bp, Homo sapiens
agcagtgcttggcaaacgtagctgtgatggttcttctgtccctgtctatggtaacaagtcccctttctagctgaagatgctaagcctgcacatcacaaggaggtgcccacaccacctttcttccatcaatttccctgcccagtggggacggtagatgtctgacagcctgcggggtccagcaacccagccactgagtaataggaccttggtcatttctgcctcgggactgtctgaatagaatgcacctgctaaatgtcccagccctttttcttagcctccttacctctcacaagaccttgaaattaatggatctcgataaattaaagactttcaacacaaacgtttgg

SEQ ID NO: 383931 - DNA, 445 bp, Homo sapiens
attccataaattccagatgggacctactacagagaacctctcgaccacatggccctggttgcactcctccttgaaggaaagtctagattccattaccttctactttccttcttatgagttgtgaaggaaggaagagaatcttagaggaagaatgaaaagaagggagatcatttggggttggctacacattgtaattagaagtaggattgatggggaatgagctaactgtttttataaagtcagcattcaaaaatgcaaaccaccagtaatttaaatattacaaaattgtgcagaatataaatattgaaataattttttccatccacaaaattttagagaaaattacagtatcaaaaaatataaaatggcaagtttggcatatcctcagagtaaagtgtgtgtgtgtatgtgtgtgtgtgtatgtgtgtgtgttttattgggaagg

SEQ ID NO: 383932 - DNA, 1074 bp, Homo sapiens
ctctggagccctggcctcctcccaggttccacatgttgctctcccaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcaggtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 383933 - DNA, 776 bp, Homo sapiens
agtggatgtctgttcatttattcatcagatattcattgagtacctagattgtaccagacattcatgggaggacggtgtaagggaaagactctggaatctggtgctctattgccatgtttctaatataaccagcacttattagctgtgtgaccttgggcaaggtctgagctacccctttgatgatcactgacaatgatacttctggcatggggctgagtgaggactaaaagactgtggaaagtatactcaacacatacctcctggctttaatattgcctggattgctctgttctgttctgtgcctctacctttctttctagggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 383934 - DNA, 1182 bp, Homo sapiens
ctctggagccctggcctcctcccaggttccacatgttgctctcccaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 383935 - DNA, 1220 bp, Homo sapiens
ctctggagccctggcctcctcccaggttccacatgttgctctcccaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaattattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 383936 - DNA, 1372 bp, Homo sapiens
ctctggagccctggcctcctcccaggttccacatgttgctctcccaatgtgagcaagccctggtggcagcgccaggtccagtgcagcccctccccacagcatgctgggggctaattctgatgtcatctttctgcagaaaaccattagaccatccctccagactgccaccctcaaagccgtctgcccaggccccatctgacactcttgacatctgcaggtcccagaccctatgatgtgtccactctggaggctcctcatcttcctcgggttgctggccttgcccttggcaccacacaagcagccttggcctggcctggcccaagcccacagagacaacaaatccaccctggcaagaagcttacccatctaattttctcttcaaccaacattgactctgatctacatcctgtatgttagctccgtgctccagactgaaatacagtgttgggtgaactttcaaccagaataccccactttgagcagctgttgcctgccacaccctctgcagttattgctcagggcctcataaagcacaacgcagaaagccgaattcagaacatccactttggggacagactgaatgcctcagcacaagtggccccaggctggtgggctggctaatcagcggcaggaaacaccagcagcagcaagagagcagcatcaacatcaccaacattcagctggactgtggtgggatccagatatcattccataaggagtggttctcggcaaatatctcacttgaatttgaccttgaattgagaccgtccttcgataacaacatcgtaaagatgtgtgcacatatgagcatcgttgtggagttctggctggagaaagacgagtttggccggagggatctggtgataggcaaatgcgatgcagagcccagcagtgtccatgtggccatcctcactgaggctatcccaccaaagatgaatcagtttctctacaacctcaaagagaatctgcaaaaagttctcccacacatggtagaaagtcagcccctggcctgatccttctctctgtgctgatggtccaggtatgtcctctgatcggtgaaatcctcgggcagctggatgtgaaactgttgaaaagcctcatagaacaggaggctgctcatgaaccaacccaccatgaaaccagccaaccctctgcatgccaggctggagagtcccccagctgacttctgctgatcagaaggaaagtccacatcttgcaaccttaagtctcccttagagtggggcttctgctaccctaaaaactttaccccaggctctgtggacataccatcctctcctacaataaactctagctctgaagggtgcacaggtccctcccacctgggccctggggtttaggtctagaagtcaga

SEQ ID NO: 383937 - DNA, 1913 bp, Homo sapiens
  misc_feature (1817)..(1817): n is a, c, g, or t
  misc_feature (1848)..(1848): n is a, c, g, or t
  misc_feature (1888)..(1888): n is a, c, g, or t
caaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaaagtggtggcagagtgactcattctcctgtccctcccatcaggtcaaatcaggaggctgcagtgaatgcctgttctttgaatgtgtagcagttgttcctgtaactctttaaaacttgggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaaaaaaaaaaaaaaaaaaaaaaaaaaaaaaaaaaaaaaaaaaaaattcctgcgggccgcangctttttccctttgggtgaggggttattttnggcttgggcactgggcccttcgtttttacaacgtcgtganggggggaacccggggggggtttccc

SEQ ID NO: 383938 - DNA, 521 bp, Homo sapiens
aatcgagctcggccccattatgatagtgtaaacaagatgatctgtgtactaattgaagaaatgcaaattaaaactataagcaggtaccttagtagggcagatataggaaaaacaaattagagcaaaacaaatcctctacaaatccaaggcaggaaaaagtggtggcagagtgactcattctcctgtccctcccatcaggtcaaatcaggaggctgcagtgaatgcctgttctttgaatgtgtagcagttgttcctgtaactctttaaaacttgggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaa

SEQ ID NO: 383939 - DNA, 1758 bp, Homo sapiens
caaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaaagtggtggcagagtgactcattctcctgtccctcccatcaggtcaaatcaggaggctgcagtgaatgcctgttctttgaatgtgtagcagttgttcctgtaactctttaaaacttgggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaa

SEQ ID NO: 383940 - DNA, 1285 bp, Homo sapiens
caaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaaagtggtggcagagtgactcattctcctgtccctcccatcaggtcaaatcaggaggctgcagtgaatgcctgttctttgaatgtgtagcagttgttcctgtaactctttaaaacttgggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaa

SEQ ID NO: 383941 - DNA, 1122 bp, Homo sapiens
tgcgccctgccttcagtggctcttttatcccccaaagactgaaagctgaaggtggagatgttctccacaaacataccctttctgaatttcccttgttttagcactgtgttcagggctctggactaaagtacctctgagtaggtaaaatcagagaatataacgatctcctgagtgattagatttctttggtagattccaagagatcttaaatcataataaactctgaatattaacaagaggtgccagggaggtgtcagtacatttcctatcatagctgccttgttcaaagcataatctcagagcagtcaagctaaactgtttgtagaaaaccatgaagatcaactcatgctcactctctacaatgcaatgtgtacgaggcttgaaggcaaaaacaattcttgggtcccaaggacaacctaaaacttaccagcttttttcaaaaacaacaatcagatgcaaataatggcagtgttgttctatgttctttgtttctgttcattatagaagcaaggaaaaattctatttctattggaaattagaagaaataatttcttcctgactctttttttttctataaacttttatttccaaggaagctgctacaatttgcagtcaattcaggccatggacgtctgtgccctaacagaagcaccgttcaatagaacagcaataaccttaaagtgtgcatctgtagtgaaactctgcacaaagtcccctgcataaagaagagaggaaagcctaccatctgctttagacgaagtgttatttgatgttctgtttccaactgtcagtataagcagcaactagagtaaaggcctgatgtgggaaactatggggggtctttcagggtagtttaccatttaaagcaggggttgaaaattcgaaagcctaaaagggccagggggcttaatgcaaatgggtgaagcagcccaggggcaagctggccaggaaatgccctgtggaaaaagggacatccacgatttacctgaaactgaatgctgctagagcttctgaattttataaaatctctgaaattatacatgatggcagttgattcagagcttagtgcagaccaaacaaatacatcactgagcagaagagggcccatagatcgtcagcttg

SEQ ID NO: 383942 - DNA, 1180 bp, Homo sapiens
tgcgccctgccttcagtggctcttttatcccccaaagactgaaagctgaaggtggagatgttctccacaaacataccctttctgaatttcccttgttttagcactgtgttcagggctctggactaaagtacctctgagtaggtaaaatcagagaatataacgatctcctgagtgattagatttctttggtagattccaagagatcttaaatcataataaactctgaatattaacaagaggtgccagggaggtgtcagtacatttcctatcatagctgccttgttcaaagcataatctcagagcagtcaagctaaactgtttgtagaaaaccatgaagatcaactcatgctcactctctacaatgcaatgtgtacgaggcttgaaggcaaaaacaattcttgggtcccaaggacaacctaaaacttaccagcttttttcaaaaacaacaatcagatgcaaataatggcagtgttgttctatgttctttgtttctgttcattatagaagcaaggaaaaattctatttctattggaaattagaagaaataatttcttcctgactctttttttttctataaacttttatttccaaggaagctgctacaatttgcagtcaattcaggccatggacgtctgtgccctaacagaagcaccgttcaatagaacagcaataaccttaaagtgtgcatctgtagtgaaactctgcacaaagtcccctgcataaagaagagaggaaagcctaccatctgctttagacgaagtgttatttgatgttctgtttccaactgtcagtataagcagcaactagagtaaaggcctgatgtgggaaactatggggggtctttcaaaaaaaagctgacactctattcatttttgggtctcaggaccagagggtacagggtagagggtagtttaccatttaaagcaggggttgaaaattcgaaagcctaaaagggccagggggcttaatgcaaatgggtgaagcagcccaggggcaagctggccaggaaatgccctgtggaaaaagggacatccacgatttacctgaaactgaatgctgctagagcttctgaattttataaaatctctgaaattatacatgatggcagttgattcagagcttagtgcagaccaaacaaatacatcactgagcagaagagggcccatagatcgtcagcttg

SEQ ID NO: 383943 - DNA, 618 bp, Homo sapiens
aggacgggcaaaaggagacgggtaacttagttcagaggaaatgagcaatgacctacaattcttataactaggagagacaccactcagacgtttcctgtgggctgggcccaagaggtctctggctgagcagcagagcagtagttatccaggttaacaacttccaattaaagccagagaggaatgtttctgggagctctgtcatgaagagaccccagtattcgatggaataaagtcataaaggaaagggtcaacaaacattttctgcaagggaccagatagcaaatatttttggctttgtgggacataggggctctggcgcaactactcaactcgacagctgtcgagcaaagagcagccatggaaaacatataaatgaatgaccatagctgtgttccaataaaactttgtttgtcgatgctgaatttgaatttcgtatcattttcatgtgtcatgaaacattgattttgattttttttcaatcatttaaaaatgggaaaaccatcttcgctcacgggctatacttaaaaacagctgaggcttggccgggcacgatggctcacgcctgtaatcccagcactttgggaggccgaggaggacggatcacaaggtcaagagatc

SEQ ID NO: 383944 - DNA, 351 bp, Homo sapiens
atgtagcataacagtgacaaccatggatttccaggtggcattgaatggctagaattggaaactagctctgtattggagacctgggagaagttaccttccaggcatttttttgtttcgtttgggctccttgagctcatggcaggcattgccagagcctaaacctgctgcttggaaaggggaaggttcttcaggtaattactccctcccttcttgtacctctgttcacctcactccagggatgattgaagaaagctccctaccatcttcctcctggcatgaaggggagcaagttctctggtcctggagatgtttcaactgagtccagatgactatttggcagggacgataaag

SEQ ID NO: 383945 - DNA, 812 bp, Homo sapiens
actcctaaagaaaggggaaaacctattaaaaatgaagctcttatttactaatgcatttctatttcaggagcatttggctaaactggggacaaaaaacaaaaacttgttcttaattaacaaaagaactagaaagaagctcatatgaaagcaccaccttgtgttcagtaagcttcaggatagctctgttgacagcagggcatttagagagtcccaagtatagtcatgtatcactggggagggaagaatctttgaggacatctagtttacaatctttattatttttcaggtgtagaaaagagattaaagatcatagaagtcagaataaatttgtaaaagttctcatagtcaaaacagctaagtaatggcattgcccagactccaaaatcctgaccagaatataaatcaccaattgttggtttaaaggggttatttgtgaatcattttccaaaaaaagaagtacactttttgtgttacttaccatttcaaagaaacttattcttcaagaccatttcagatttccttaggaatgtatgtgttacccataattgaccacttcaaacttgtaagaaaaaaaatgttatggtcattttgttatttttagagacaaagtatttctaatctaggtttgcatacaaccttgaggctgtgagatcattagtcaattgctttaattataagccctgttttttttttaaatctaaaaactaataaacatctataagaattataacagattattttcttcattaaattactttgtaatcaagttctagattaaatgtttaaacatgcattaaaggattagttctgaa

SEQ ID NO: 383946 - DNA, 308 bp, Homo sapiens
ttatctaatgatctcttggacttaaagcactttgtttctgcagttacttcgcatgagtgtttactgcctctcagtcagcattctttacagtattaatacacagagaaggaaggaccagctgcattagaatcactgtaacttgttgaaaatccacatttccagacttaacacccagatattctaattcagtacgtctgagtgaggtccaggattctatatttttaacaaacatcccaggtgatttgcatgaagaccaatgtctgagaaccactgcttacaggaatcagagtactttgctggcatctttg

SEQ ID NO: 383947 - DNA, 414 bp, Homo sapiens
gtcagtcttccataactgtttcctgctgacaaaggggcagtggtgatggttctgtgggtcttggcctcttgctagctgtcacagcaggagggtggctttgtggattggtgaaagtggtatccagccaggtccaagagagacaggggcagggttttgccaatgccaaatatacttcagcagtagaagccacaagattacattattaaattgtcccaagagtcccccagtgcaaaccccagctgaacgccatttagttatattctggtgcgttttccttctgcaggaactcaaaccaaggtttcttatgtgtgcttgagttgggggccagagtgacaactggtagaaaactatgttattccccagctaggagaacagaggggaggggtacatgatagtagggagtcaagtttacag

SEQ ID NO: 383948 - DNA, 2003 bp, Homo sapiens
tgggggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatacacaatcccaaactggaagaaattttaaaaaaaggaatcctgctgtgaaaggtatatattactctagatttttccttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaaga

SEQ ID NO: 383949 - DNA, 1721 bp, Homo sapiens
tgggggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattgcactccgggcaggcattgcactccgggcagccattgcactccgggcagccattgcactcggg

SEQ ID NO: 383950 - DNA, 2891 bp, Homo sapiens
tgggggaaagatttttgagtctacaactgacaaaatgtcttcttcaaattaaaaaaaattgagaagcagcactttaagtctaactctacaccattttattgcatgtattagttttattaatgatttttggtgcatgcctttgggcttattcaaaagtgtacaataggaaagtatatttcctttcttagaaaggagatgttttctactttgcaacatgtgattacaaaaatcttcctctgtgggaagattaaccatgtattgaactactgaaaagtatatatttttagatatacagaaggaatctacatggagcagcattcagacctatatagaagtcatagcattctgtataggaccaaaaaggaaataacattaaacacttaaacagacgttgttgggtagaaatacctttagatcttgcatttacttccaaaaagaaaaaatgccacagaagtttgctgaaaacttttgtcgtttgaattttctctgtcagtgtatttagcccaaatacaacagctttgggttagcacacacataagaatcaaaaaaacaaagctcactaaataaatcagtctggtttgccaatccagcttgactgaaataagtaaaccaatcacttgcaacatgaaaaactgtccaactcctctaaggttctgacaaaataaccttggctgatgtgggaagactcccactttgattactgacctgacagtgaagattcatgcttgacatgatttcagacttgacaatgtctgtttaaggagctatggtacagtttgctaattcaatcccagatacctgttgattacctgtgagatctagagtccaaagtagccagcagccatatccctgagtgctctgtgcccatcagatatcttaaagtaagcagggttgggacaggtcacagcttggatgattgacctcaggtgccgtagacagccccagattcaagaattgtatctgctttcttggcagtcgtcactgaactaatgtcccatactgtgttacttactgtagatgctctcttttagaggaggcccagagcacacatcctaatcgctagcggtactcagagagggggtgctaactctgatgccctggccaaattccagtttagggatgtgggtcttcttcttgtcattctaattggaaatgtgcatcacttcccatttttcttactgatctcagtgcaaactacactagtctgtttctttgccctggtctcaagtctctaagacgctggtgtgtattatgtgggctaagttcatgtgttatcctaaggcacaagagttgaggaatgggtgagcttggtgtcagagcactgtgtggttggagggtggactcttgtgatgctgtggggatgaaattggccctcttttagcataagttggggagtgtgcactggctggaggcttccagaggcttccagccatgaggtgtgagctgaaaccaatttttcctctttccttatagcatgttgagaaaatctgttgggttttcagcagtcagggaaggccggagttctgctttaatctgggtaactgaggctaatatgagcaagactttggttaattaactgggttctcagatgccacagactccgtgagaagtcaccattattttcaatggttgtgatagaatttcccccagtagccattattttaagattatattgcagagttgctttattttgagctttttgtgtatacacaatcccaaactggaagaaattttaaaaaaaggaatcctgctgtgaaaggtatatattactctagatttttccttactgtaaatattgtaagattgtaatactgtcgatattttattaaccaacaaatgttaatctatgtgaaatcagacttattttaaatgtgcttcttatttactgtgtgtggtccctgttgctgacagtattaagttatattctgatgtaagattaactttattaaagaatgtaaacattaatgtttccttatgggaaaacaaataaagtataaagaagacaattcttttcattgaaatatactgtgtatttacacttgctagacccagcaccacttataaatttagtacactgttcagaattttagttaacacagctgacatggttgtgctctgtttgaaagtctaagaataggtattgttggaatatacagtttgtatttgtctgctgtgaatcataatcttgaaatttctaatcaagtttgtaaaatttttatagtgaaacattttaatgacaatttaaaaatttatcttctctaaagaatggtcaaaacaatatcctttcagaaatagaattgttctttaatatctttccaaaatgactttggttaaatggaccagatgtatattagttaaaatttaggactaagttgttgatattctttgagtttacaagttaatccttattggagatgtgccaatatacagttagaatatcattaatttgcactgtttggggaccccatttaagaatgctgaattttgccaactaagaagtaagcaaatgcaatttaaaaagtaaatttgagcattctgtattaaatatgtgcagttattatcacatgaagaaacgcagtgtgtcgggctgtaatattaccatatttgctgtcatgttctcccatctcagtgctgggaaatcaccatgtggaaaccaagcaaacgtgttgtgcatcagccggcttgagtttgttcaatatcaaagctgaaaactagcgaggtctgctgtactgcttattgaagtattgtgattattttaggcattgattcttacaaaatatatactgtaacagtatactttgtacagatttaaattttatttgaaaaaatgaaataaagtaggcaaaaaaataaagatgtttatttttcatgtgactgtataatcaaaaaaa

SEQ ID NO: 383951 - DNA, 400 bp, Homo sapiens
gtcagatgacataaaaggaatatttctaactatagttcttgctccttttgaactttaactgatacaaggacaaagggggggaaatcacattttcagattaaatttgctcttgtcgctgcatgtgctactaggaattaagccctgttacaaatcctccttgtctcctctattcccgttagcattgtttttgctgcagtcaggtactggccttctggaatattcctccagtggcatgctgtaccttaaggttgggagcagctatatatacacagggtacaggctctctagcctcttccgagcatgctattctggtgcctttgttctgtcttaagttcctccaacattcatcttcctctttcagagaatccttgttttacagaagaggccgcttgtgaaagag

SEQ ID NO: 383952 - DNA, 440 bp, Homo sapiens
gaactagagatcatgaaatctggttccattcctttatataagccctaagtccagactaaaacccagacctcttgatacctattatttggctttttaattccaattgaatgaaagaagaaatgattgaatgtgaataaataaaattattgagagctagtttgagcaaagcatcatgtaagatattgtagttccaaaattcagatgttgtcctgtctagagaaattcctcactttctcctgggaaagacagacataaaaaagatctgtggtaacatcatatccttagtgctctaacagagctataaacaaagtactctggggacacagaacatagcaacttactctgtttaggggaagtttaagtttaagacttcacaaaggtagtgttgcaggactagtcttgaggatgaaggagcgtttggcagactgaaaagaggaaaa

SEQ ID NO: 383953 - DNA, 415 bp, Homo sapiens
tttcaaattttgcaataccctctctcattaacaggtatgaacaatgatcttttttttttaaccactactttgtagagtcattaataatcagcctagaaattagtaaagataatgttgtgggctgaaagtttatgtttcctccaaatgcatatgttgaaacactaatctccaatgtgatgctattaggaggtagaggtctttgggaggtcattacgtttagataaggtcataatgatagaggcttcatgatgggattagtttccttataagagtcagggactaaaactctttctctctctttgctgtgtgatgacaaagcaagaaggcagtcaacagaagccaggaagagggctatcccaagaacctgaccatactgacaccttgatctaggactccgtagcctccagaactgtga

SEQ ID NO: 383954 - DNA, 227 bp, Homo sapiens
ccagcctgggccacaagagcaaaactctgtctcaaaaaaaagaaagaaaagaagcattaattatatataacataagtaattaataattaatgaaagccaagcacagtggctcacacatgtaattccagcactttgggaggccaaggcaggcagattgcttgagcccatgaattcaagaccagcctgggcaacatggcaagaccccgtctccaaaaacaaaaacaaaa

SEQ ID NO: 383955 - DNA, 298 bp, Homo sapiens
gagaaatgaaatcacttttttcctacaatcttcaaaataattacatatccagaaatttatattgtacaaaaaatagagttttttttaaagtcttttttgagctaaattcattgtgttatgcttgccaccaaattctgagaccagcattaacataaaattttctacctcgtttggtaccctaaaaattctagttgcctctggcaagctattgacaagaattttagacctctgatgaaataaatgtatcatcatataataatttctgatgtgaggttttaagattaaataactcactata

SEQ ID NO: 383956 - DNA, 878 bp, Homo sapiens
ggcggctcaggacgagggcagatctcgttctggggcaagccgttgacactcgctccctgccaccgcccgggctccgtgccgccaagttttcattttccaccttctctgcctccagtcccccagcccctggccgagagaagggtcttaccggccgggattgctggaaacaccaagaggtggtttttgttttttaaaacttctgtttcttgggagggggtgtggcggggcaggatgagcaactccgttcctctgctctgtttctggagcctctgctattgctttgctgcggggagccccgtaccttttggtccagagggacggctggaagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgt

SEQ ID NO: 383957 - DNA, 857 bp, Homo sapiens
ccccacaccacctgagtccagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcagataagctccacaaacccaaagctacacagactgaggtcaaaccatctgtgaggtttaacctccgcacctccaaggacccagagcatgaaggatgctacctctccgtcggccacagccagcccttagaagactgcagtttcaacatgacagctaaaacctttttcatcattcacggatggacgatgagcggtatctttgaaaactggctgcacaaactcgtgtcagccctgcacacaagagagaaagacgccaatgtagttgtggttgactggctccccctggcccaccagctttacacggatgcggtcaataataccagggtggtgggacacagcattgccaggatgctcgactggctgcaggagaaggacgatttttctctcgggaatgtccacttgatcggctacagcctcggagcgcacgtggccgggtatgcaggcaacttcgtgaaaggaacggtgggccgaatcacaggtttggatcctgccgggcccatgtttgaaggggccgacatccacaagaggctctctccggacgatgcagattttgt

SEQ ID NO: 383958 - DNA, 353 bp, Homo sapiens
ccccacaccacctgagtccagacactgggctctggccacgcgtcttagactccaaatctcggctcactggtccctttgaggaggtcgcctggtgttcccgtagccctccaccccaccgtaggagagcgcctgccacgagctccgcgcctcgctaagtgctttgctacgtgaactcttagttttcccaacatccctaagccgccgatacattatcacccacgtattgcggacgagagaaccgcctcggagaagctggctggctcgcttggagttttgcagctagtggcggagcgagcattccgagcaggtactgtgcgatcctccagcgccggccgcagctcacagccccttag

SEQ ID NO: 383959 - DNA, 507 bp, Homo sapiens
tgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtc

SEQ ID NO: 383960 - DNA, 312 bp, Homo sapiens
  misc_feature (163)..(163): n is a, c, g, or t
  misc_feature (171)..(171): n is a, c, g, or t
  misc_feature (257)..(257): n is a, c, g, or t
  misc_feature (262)..(262): n is a, c, g, or t
ctaaaggctgaagaggagtgggccagggaaagagctatggggtgaggagaggagggtcagggagaatgtccccagcagaagacaccctgggcaaaggctggaggaggcaagtgaccatctggctggagcccagaagtaagaaggtgggaagcatacacatgtncatgtttntggtgtggagaggcctagaatgtcagatggcaaaaaggaagtagttggccatacggctttggtcgtgttgttgagtatcgtaattncccanctctaaagagttgagattggattctttaggcagtagggagccatttaagt

SEQ ID NO: 383961 - DNA, 425 bp, Homo sapiens
ttaattacagtataaaagggtttctagctgttgaaaaggttgggagctactgaattaggcctccagatcctgtggcctacctgttatacctcaaagcctcaattttcagccgcttccttagcctttctcaaccagggctgtgagacagttaagctctaaggaaaattgtttgagtaactaatatcagttctcccaaggactgtatttaggtattctttacctaccatggatgtgttagggccagactctcttggaaggatgcttctcttctgttctcttcccttgccctctccctctctttatgcttctgttttgtgatcccccatttacacacaggaacaacctcaaagttctgggttgggaattggggaccagaaaatgactatagctttatcttctaatatttgtgttgattaatgcttgaa

SEQ ID NO: 383962 - DNA, 375 bp, Homo sapiens
ttttcctttttttctgaaaaagacagtgcctcccactcccacccactccctaaactcaactgaccactaaatattgcacatttttcattcttgctcctttaagaaataaaaataactcagagtcactagctcttgccccctcttatactttggtatttcagacatttaaatctagtacctaaaaagaaagaattaatcatcatggccaaagtgtgttgatattactttagttccaattataccaccaactgaatcaagatgacttagagtgtcaacacatgtttttcaacaaattatgtctatttgctttttagtatgtattaaacaattcatttcacatgtttatttatgcagacttttgaatcattctacgta

SEQ ID NO: 383963 - DNA, 438 bp, Homo sapiens
ctacctcagggcaactaaaccttcttgctatggagtgttcttaataatacaaaaagagatgcatcattttgaggggggtttattttaacaagaaatatcagatagaaatagatatggatgatagttggcgcgatcaacaaaattaaaagtgtgaaagcatgtcattacttgtgtatatgggctttgtaattttcaaagaatttgacatgcattaaccccttctgtaggatgacaaaatgtaagagcagctgtaatcttagagaccaatgcatcccttactgagaaaatgacatccatagattatactgatcagttatcattgactatagtatttagagtaattaggaatttcgcatggcagttaaatctcactcaattttagatgattccaactatgaaacattacttgtgtctcctgagctatcatttttttcttgt

SEQ ID NO: 383964 - DNA, 350 bp, Homo sapiens
cagccatttaacaatgtaaaatccattcttagttcatgagaggtacaaaaacagacgttgtgctaaaatgtgcctgcatgccatagcttacttatcccttctctagggtattaattgctgacaagccctatgaagtcagagaccttgtctgctttgtttcattgctggagctccaaccctggtatcacacctcacgcagagtctatgctccaaaatatttgtggaatgaaatactactgccatgttaaattatgcagcatggcacaaatcctatgttgaaattgagcgggctttatttattctactctgcatatatgtatcatatgcctactatgtgttctcctttgtgc

SEQ ID NO: 383965 - DNA, 443 bp, Homo sapiens
ctaggtagtgggccaaagaatgaagtagttaaatgtagtgattgagtcagaaacttcatgtatgtagaaggtagctatatggagagtgtagtgaaaggaaagaggtgaggaattgaaatgtcaactctgaattatctgtgtggccaatttactttgtattatatgtggcagtatttttgttctaatttgtcttcctgagaattgggccagttccccgtcatcactgcatttatagaagaaaactaattcttacattcataggtatgggaagagcatgaataacaagacaataaaagtgatatttaatatttaaagtcaattatagggccaggattggtggtccaggcctgtaatcctagcactttgggaggccgaggtgggaagatcagttgaagccaagagtttgagaccagcctgggcagcatagtgaaccttgtctctac

SEQ ID NO: 383966 - DNA, 459 bp, Homo sapiens
tgcctggcacagagtaagtgctcaacaaatgttagccacaggtgggtttttgagtcagagagatgtgcacaagtgtttttgtgttggtgtgtgggcaagtaactatgtggccctgaaccagcgcacgtatcagtgtataaatagcctgtggatgagtgacctggtgggagggtctgtgcagaggcagggccaagagtggaggtttgtgtgtgaaaggcccctggtgtccatccgtgcctgtgtgtgtctgtgttcccatgttaacttgcacatagtctgtgccaagggtgtttctatgtctttcattcatgtgaggatcagctccctgacatttgccgtatctgtccccagtgcctctcctgggattcacactgatgctattctttaaactgactccttttttacataaattatgtttacatgtaatcaagttaaaatacatcttaaatgtattcttta

SEQ ID NO: 383967 - DNA, 1101 bp, Homo sapiens
ggacacaaacttcaggaaaggatttgcacttgtgcagaccgggcgagcagagtaagaagcagtctcactgtgtcgcccaggctggagtgcaagtggcatgatcttggctcacaactgcaacctccgtctcccgggttcaaacgattctcctacctcagcctcccgaatatctgggattacaggtgcccaccaccatgcctggataatttttaaaaatatttttagtagagacagggtttcaccaactaggccaggctgctcttgaactcctgacctcaggtaatccacccgccttggcctcccaaaatgctgggattacaggtgtgagccaccgcgcctgaccaactttagcttttcaaaatctgtcttcgtagacgataatggaaatatctaccaaagctaaatattcacctaccccatgacccagcaattttactcctaggtatatataccaaaaaaaatgagtgttctgtgtccactagagatatgtgccaaagtgttcataatagatccaaactggaaacagctcaaatgtccatcaatagcagaaagataaacaaatgttgggatgttcagagcttgaaatatgacacaatataaaaggacaaactattaaaactcacaacagcatggataaatcttacagacataattattgagcaaaagataccagaaacacaaaagtatatactgtctgattcctttaaataaaggttaagatgattctccctcctgcagccttggtgaagaaggtgccctttcttccccttcggccttctgccatgattgtaagtttcctgaggcctccccagccatgttgaattctcattgtccctgataaaatagcaccctctcttcctctgctcttccacccttttcctcttccgctgtgcaactgaagactgggaaagaatgacatgcaaaataagaggttttggattcagcgtaggactaactactggatgctacttacagaaaactttatatttgtgctgaaaaatcttgttatctaggtgaaagccaatgctatcctaatgacaaaattgttggggaaataaatttataagagactttatttaaagaaataaaagaaaaaataat

SEQ ID NO: 383968 - DNA, 370 bp, Homo sapiens
ccggctaaaagtttaatttctttaaggataaatgtgctcttagaaacagggaagaaagaggctattaaacccgaaagggaaatggaaacagaacatgaataggaaattagggtttcacaaacactagtaattgtatgtgataacaaaagaaaattaattgaagacttaaaatattaagctatatttgtgaggttatgggaaatgtatcactcattcttacattttaggaaattttttagttatgattcagatatccacaaacttaattctaagtattgatcttcataagctttctatgtaatgaaataacgtaagacatagcaattggatgtaacctatgtggatttcagtgaaactaccaggcatgtat

SEQ ID NO: 383969 - DNA, 255 bp, Homo sapiens
aaacaggataaatattaaggaaatcacgcctatgcacctaatagattgctgagaaaaataggaaagtttaaaagctgtcggagaaaaaagggaacaatgatgagaatacatgactagaaaaaaatgcaatcaagaagacagtcttaaatatctttgaattgctaaagtaaaaatactgccaaactaaaattctatatccagtgaaaatattcttcaaaacgagtgaaatagtcgtttttggatatgtgaaagttg

SEQ ID NO: 383970 - DNA, 463 bp, Homo sapiens
aagtgtcatgagggaacatggagacggaggtcaagaagaggagtctgtccctcgaagaaaggtgatgtggaacctgtggaggacaagttgattgggtactagtgagcgaagacttcactaataatgtgtgtgaaaagccaaaacctaagacacaattaagaaaaaaacaaaaacaattaaggaaaaataccatcttggtttctggagagaagtacaattctcaggcctgaggcctttgggaagggatgagatgcagattccaactccttctccttatgagctgttgaaaactgctggggaaaagaagcatccactgctctgagtcttatcatcatatattagttttgactactcatatactcatacatagttttgtcaacttcatatactcatatatagacttcccagactcatacttaaaaaaaaactacatacatagacttcatagactcatgcagttaaa

SEQ ID NO: 383971 - DNA, 724 bp, Homo sapiens
gtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggtgagtgacctgtttctgtctggtaaactacccttgcgtgtaactgtcactgagtggagcgatggagcctgagggtggggatatgcattcctgtcatgctcagcgttgtagactgttttgttgcacacttagtaaattacccagtgcaacttccgct

SEQ ID NO: 383972 - DNA, 2498 bp, Homo sapiens
aatggtttcaaccaagattgaaaaaccccagagtatgattctattctccatatgtagagaaagatcctgccttgtccttaacctggacctagctttgcagatgggctcagagtgtagaattggcaggtgatccacgacccttgctcagaatccagcatgaagtagtgagacagggaaccctaaacgaggtctgtaggccacttgctgctacaaatcatgcttgcttggttgctattcctagtgtgacaggcggccttcccagcccagctctctgtgtttctaaaacgtgtttgtatgacagaatcctacaagaggttgcttggctctttccaagcttgctagacacaagacaagtgtatcctgacttatttgtgtgctttctttttgctctttctcctttatcttcctttagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383973 - DNA, 2458 bp, Homo sapiens
gtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383974 - DNA, 1514 bp, Homo sapiens
caccttagggtttgggcggagcgtcccacatggggtgcctggtgccaaccccacccagcgcctcgggacagccaggtgggccctggaaagactagccctcctgccactagctgcgtccctgtccccagtgtattgtacaagtaggattctcagagtgggttgtgagaagaatgggggtagccagtctgactctgggggcaggagggaggctgagtggctcctgctcgccagcaggggcaacagtgctagcttatcccagcagatgcttgacttcctgtcatctcttgcaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383975 - DNA, 2161 bp, Homo sapiens
cccgcccgagcccgctgacccccgtccgccaacagccccggcctgcggtgccctccccgccccggggcgccccggagcctggcgcccagaccccgcccagaacccacccagggcacacccggcccgagatcccctgcccgcgccttcaccccggacgcccccgaggcgcccccttcccgcgcgccaccctcccccagcgtagccggccgcacaatggtctccctgggctcccagggcggcgggattgtgcgcgggcgcccggcggtgtttggtgaggggcgggcccggcccccgcggtgccgccccctcggccgcccagcccacctctgcaggtgccagctccgaggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggtgagtggatgaaccttctggacgctttggtgggagggtgtagggtcaggcacacctggagagcttaggaaggtggggagcaggctcggtttcccaggaagaagagaggcccagaggtgtcaaagccaaaccgagggcctcgaccctatgagtcacccgggaggctcttggccaacttcaacctgcatctgtgggggtaggatccaggccccagcatcctccaagtgagattgcaggtatgggaggtgaggtggtgcgggagtcgcgtgggctgggggctcaccacccaggtgaagccagcaagtgagaccttgctccaaagccagtgtcttggcccaacccggccctaagtgaatcagaggcttcatttttaaccaggtcccagtggatt

SEQ ID NO: 383976 - DNA, 1327 bp, Homo sapiens
cccgcccgagcccgctgacccccgtccgccaacagccccggcctgcggtgccctccccgccccggggcgccccggagcctggcgcccagaccccgcccagaacccacccagggcacacccggcccgagatcccctgcccgcgccttcaccccggacgcccccgaggcgcccccttcccgcgcgccaccctcccccagcgtagccggccgcacaatggtctccctgggctcccagggcggcgggattgtgcgcgggcgcccggcggtgtttggtgaggggcgggcccggcccccgcggtgccgccccctcggccgcccagcccacctctgcaggtgccagctccgaggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcagggcgacaaggatccacggacagagcgtatgaccgtagggacgcgtagacagggaga

SEQ ID NO: 383977 - DNA, 1091 bp, Homo sapiens
cccgcccgagcccgctgacccccgtccgccaacagccccggcctgcggtgccctccccgccccggggcgccccggagcctggcgcccagaccccgcccagaacccacccagggcacacccggcccgagatcccctgcccgcgccttcaccccggacgcccccgaggcgcccccttcccgcgcgccaccctcccccagcgtagccggccgcacaatggtctccctgggctcccagggcggcgggattgtgcgcgggcgcccggcggtgtttggtgaggggcgggcccggcccccgcggtgccgccccctcggccgcccagcccacctctgcaggtgccagctccgaggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagtgccgcgggaagccatcagagggttttgtgctgaagcgtggtgcggtctgatgttttacggcgtccttggtgagagtggttggacggtgggcaagtgtggctgctgactggccagttaggggccagtgctgcagcacaggtggcttggaaccaggcagtggtggtgac

SEQ ID NO: 383978 - DNA, 288 bp, Homo sapiens
ttctaaaacgtgtttgtatgacagaatcctacaagaggttgcttggctctttccaagcttgctagacacaagacaagtgtatcctgacttatttgtgtgctttctttttgctctttctcctttatcttcctttagagaagttggtaagccctccagcctcagccgctgcttccagccctagctcttctccatctccacagcccgtttcagagcttgacttgtcctcagagccacagcagctcactgccaagggtaacagcagtttgggagaactgcatgctgtcttgc

SEQ ID NO: 383979 - DNA, 358 bp, Homo sapiens
gcatgtcgtgaaggccaggcagtgagggcgatgggatggggctgtaactcgatgggaagtggatgatcagttctcacaggcagagcaggctgcgcagatgagtgcgggaagtgcttccagacaggccgagtctgggggatgggttcctgtagggttttgtagggcatggcagtgactttggcttttgttccaagtgccgcgggaagccatcagagggttttgtgctgaagcgtggtgcggtctgatgttttacggcgtccttggtgagagtggttggacggtgggcaagtgtggctgctgactggccagttaggggccagtgctgcagcacaggtggcttggaaccaggcagtggtgg

SEQ ID NO: 383980 - DNA, 551 bp, Homo sapiens
agcaataatctttcaaaaacaaaaaacaaaacaaaacaaaaaaaggaattacatggacaggtgaaactggaactgaaatgctgtggaaaaggcagctctcaccatactggaaacttgcaccccaagggctcctccagcatctcaagggtgcaggctgatgggacggtgcttgtttcccagctgaacaagcgccctgatgaaggcgtgcggggtgatgggatggccttcgccgttctcacccgatgtctcgttgttcagtcttccctgggttctgcctccgcctcgcccttccagccgcacgtgccttacagccctttccgagggatggcgccctacggcccgctggcggccagctccctgctcagccagcagtatgccgcctccctgggtctaggtgagtgacctgtttctgtctggtaaactacccttgcgtgtaactgtcactgagtggagcgatggagcctgagggtggggatatgcattcctgtcatgctcagcgttgtagactgttttgttgcacacttagtaaattacccagtgcaacttccgct

SEQ ID NO: 383981 - DNA, 2994 bp, Homo sapiens
cccgcccgagcccgctgacccccgtccgccaacagccccggcctgcggtgccctccccgccccggggcgccccggagcctggcgcccagaccccgcccagaacccacccagggcacacccggcccgagatcccctgcccgcgccttcaccccggacgcccccgaggcgcccccttcccgcgcgccaccctcccccagcgtagccggccgcacaatggtctccctgggctcccagggcggcgggattgtgcgcgggcgcccggcggtgtttggtgaggggcgggcccggcccccgcggtgccgccccctcggccgcccagcccacctctgcaggtgccagctccgaggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctagagaagttggtaagccctccagcctcagccgctgcttccagccctagctcttctccatctccacagcccgtttcagagcttgacttgtcctcagagccacagcagctcactgccaagggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383982 - DNA, 2877 bp, Homo sapiens
cccgcccgagcccgctgacccccgtccgccaacagccccggcctgcggtgccctccccgccccggggcgccccggagcctggcgcccagaccccgcccagaacccacccagggcacacccggcccgagatcccctgcccgcgccttcaccccggacgcccccgaggcgcccccttcccgcgcgccaccctcccccagcgtagccggccgcacaatggtctccctgggctcccagggcggcgggattgtgcgcgggcgcccggcggtgtttggtgaggggcgggcccggcccccgcggtgccgccccctcggccgcccagcccacctctgcaggtgccagctccgaggagcagggcggctcccgtcagcgggcctcctccccgccagcctggggggatccctgcgggggagcctcgaggtcgggtggcggggccagtgtcccggcgtctcccgaaggctgggggtggggtcacaacacgcgaatcctgcaagcctttctggaacttattagacagctggggccttgatcctgaacaaataccgcgtcctaatgcggcctcctgccaaggcagaagcatccgttggcagccagatgccccggtttaaacgtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383983 - DNA, 2536 bp, Homo sapiens
gtggcgaggaggcgcccaggcggaggcggcggcgggcggaggagcgcaggagcgggcggccaggccaccgcgcggcggcggagcgggccgcggcccggcgctccttccccaccgcggcccgacgcaccccggccgccgccatgagcggctcctcaggcaccccgtatctgggcagcaagatcagcctcatctccaaggcgcagatccgctacgagggcattctctacaccatcgacaccgacaactccaccgtggcgctcgccaaagtgaggtcctttggcactgaagaccgtcccacagataggcctgcgccccccagagaggagatttatgagtacatcattttccgaggaagtgacatcaaggatatcactgtgtgtgaacctccgaaagctcagcacacactcccgcaggatcccgccattgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383984 - DNA, 2363 bp, Homo sapiens
agcaataatctttcaaaaacaaaaaacaaaacaaaacaaaaaaaggaattacatggacaggtgaaactggaactgaaatgctgtggaaaaggcagctctcaccatactggaaacttgcaccccaagggctcctccagcatctcaagggtgcaggctgatgggacggtgcttgtttcccagctgaacaagcgccctgatgaaggcgtgcggggtgatgggatggccttcgccgttctcacccgatgtctcgttgttcagtcttccctgggttctgcctccgcctcgcccttccagccgcacgtgccttacagccctttccgagggatggcgccctacggcccgctggcggccagctccctgctcagccagcagtatgccgcctccctgggtctaggagctggttttccatccatcccagtcggcaagagccccatggtggagcaggctgtgcagactggttctgctgacaacctgaatgctaaaaagctgttacctggcaagggcaccacagggacgcagctcaacggtcgtcaggcccagccgagcagcaagacggccagcgatgtagtccagccggcagctgtgcaagctcaagggcaggtgaatgacgagaacagaagacctcagaggaggcgatcaggaaacaggcgaacaaggaatcgctccagagggcaaaaccgtccaactaacgttaaggaaaacacaatcaaatttgagggtgactttgatttcgagagtgcaaatgcccagttcaaccgagaggagcttgacaaagaatttaagaagaaactgaattttaaagatgacaaggctgagaagggggaagagaaggacctggctgtggtgacccagagtgccgaagcgcccgctgaggaagaccttctggggcccaactgctactatgacaaatccaagtcgttcttcgacaacatctcttctgaactcaagaccagctccaggcggacgacgtgggccgaagagaggaagctcaacacagagacctttggggtgtcagggaggtttcttcgtggccgcagttctcggggcggattccgaggaggcaggggcaatgggaccacccgtcgcaaccccacttcccacagggccgggactggcagggtgtgagggtgcagccaaaggctcctactgaagtggcgcataactgacgctgtgtgtgtcaggacgcgaggaaaacgctgcacttacagggagaggtggtcactttgtttacggagtttggaagagacccatactgctacttgtgttttggacttaactgaacttggacatggtctgagttagaaccacttgttttggggaagtattcatgggtaacctctttgaggtctctttatctgtgtttcctttttagttgcgcatagcctaattctaaggttttggtattttgcaaaaaggtttctatagtgaaagctgaatccttactttgtgacttttttttttttttttaatgacaagctttgacttttaaaagtggaaccaaatctgttggcagaggtggcagccaagtacatctctgtaacccagctggcccctggtgctgttggcctggcaccccactgccaagggtggggtctcaggagtcaggcagggccagcacagggtggcgtggggggcaggggtgggtgggtggagggcacggaaggggttttcccatggatcatgttgtataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattttaaaaaaaa

SEQ ID NO: 383985 - DNA, 2408 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383986 - DNA, 295 bp, Homo sapiens
aggatcctgaaacatctaacttgaataccccccacgttgtaagacaagccaaaatcaggggccgtccctagaccttgcgcatgtaccacatcaaggtttctaccagcggtatgcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383987 - DNA, 2353 bp, Homo sapiens
cgaggcgcaggcggagcgggctggagcatgtccggccctttgttctgcgctcgtgcgtgtgtccgggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383988 - DNA, 2572 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatgtgaggcctgggggatagagggggttgggcagcagacagggaggtcctgacagccttgccctgaacccctgggagacccttgttgggtctgagactctgacctttcctctctgcagacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383989 - DNA, 2330 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383990 - DNA, 2282 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383991 - DNA, 1640 bp, Homo sapiens
gcctcgtgccgcctcgtgccgaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383992 - DNA, 1715 bp, Homo sapiens
gacgctctctctgtggggtgacgctctctgtggggtgacgctctctctgtggggcgacgctctctctgttggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383993 - DNA, 1307 bp, Homo sapiens
ttgttgatggtggatatacaggcattggttaccttggtgtccttgttaatggtgatcctcggccctccgcagccggcgtcacttacttctcgccctcgaagagcaagaacgactcgaaggctggaggggcgttcatgctcccgccgccgttgcgtccagaccccaagtgtccgccaccgccgccaccccgtcgggtggagccggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383994 - DNA, 1061 bp, Homo sapiens
  misc_feature (1025)..(1025): n is a, c, g, or t
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacgagagcgtcccccacagagagagcgcnccccacagagagagcgtcaccccacagagagagcgt

SEQ ID NO: 383995 - DNA, 1144 bp, Homo sapiens
  misc_feature (1108)..(1108): n is a, c, g, or t
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaaggtgagggaggggtgaggagcagcacctggagcccccgctgtgcggattggccgcacggtcccctcataagctctcccccctagactactgcctcgcatccaacaaggtgggtcgctgccggggctctttcccacgctggtactatgaccccacgagagcgtcccccacagagagagcgcnccccacagagagagcgtcaccccacagagagagcgt

SEQ ID NO: 383996 - DNA, 142 bp, Homo sapiens
ctcccttccacccgtctgtgctctggcacctgtcagcccacccagttccgctgcagcaatggctgctgcatcgacagtttcctggagtgtgacgacacccccaactgccccgacgcctccgacgaggctgcctgtgaaaaat

SEQ ID NO: 383997 - DNA, 2333 bp, Homo sapiens
gctgatcaggtgtgtctcctcctctgtcccctcccttcttctcagggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383998 - DNA, 2456 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 383999 - DNA, 2381 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 384000 - DNA, 2400 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 384001 - DNA, 3137 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctggtgtgagcctctccacaagcctgttgagtggttgagctctccacaattctgctcatttggaggttggggttaggggtgcacaggcaccttggctcctacctccatgttagggcccaggtgactagctgtctccctcccaacagaagccctggcttctgcgctggagtgcagcacccccaaccaggctctgagctccttcccaggagcctttagtagagacacgccactccaacccacacccctgcatttgttcaagctacctcccggtgccaaaaaaaaaatcatactttgagctcattcgttcgtttattcagtgaattacattgagctcctctgtgccagacactgccaatcattagaaatttgatactgctgagaggggcagaggaagcactatttaaatgctttacgtatctcgagttgctggcgctgcacacagcccttgtgatgacaatacaatcatccgcattttacaggtg

SEQ ID NO: 384002 - DNA, 1434 bp, Homo sapiens
tgctaggtagcgaggctgggtttgcccgaacctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccgtggaaggcgggcacagagccatcttcttcaatcggatcggtggagtgcagcaggacactatcctggccgagggccttggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 384003 - DNA, 1416 bp, Homo sapiens
cgtgggtccttgcagagcgtggcttccttgcagaggagcaggaatttaatcaaaaaggccaaatcccatgtcatcatctgactcttcagactcctccttcttctcatctttcttctcctctgctgcagcaggggcagaaccagcagcaggggctgcagagcctggggcagcagagacggctacagccccaccagcaggtacactggcaagcttgccaataccctgggcaatgacgtcttcaatgttttttccattcagctcactgataaccttgttgagccggtcgtcgtctgcaaggaacccacgccttgggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtgga

SEQ ID NO: 384004 - DNA, 1131 bp, Homo sapiens
ggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaa

SEQ ID NO: 384005 - DNA, 530 bp, Homo sapiens
aacatataggaatacctactgttgatcagattttcatgacaatttaacttcccattccccatagtccaagagggttataaaaccagatttagccattactgcctttttaaaaaattaaatgatgggagtcttcctctgtcgcccaggctggagtgcagtggcatgatcatagctcactgcaacctcaaacttctgggctcaagtgattctcccacctcggcttcccaagtagctgggactacaggtgcatgccacccatttaaaattttttttttcttagagatgggagtcttgctatgtttcccaggctggtctcaaatttctggccttaatttcctgatcctccttccttggtctcctgagtaactgggattacagatgtgagccaccacacctggaggccatcactgtcttactgttccaaccaagtggtagaactggaaaacaactattctggtatattcaatttgctgcagaaatctaccctcaaattacctgtatctcatctatattaggaagaattttaatag

SEQ ID NO: 384006 - DNA, 415 bp, Homo sapiens
tgtacttgccctaccagcacacgggagtgcatcacacaccccaacccacaccaactgccattgaagatggagccctggcaggcacagagccaaaaatcccccacccccaccagcacctcacccttgacctaatgctgcagagaggaaaagggaccctcttatatcctgagggaccactgttgcttggggagcacagagaaggcacctagacccgtgctggccagcacctcaccccaaaccaacactatctccagtgcaacagcacacacagtcagcaggggccccctggtccccaccctagctgtcttgcctccaccactgggtgaatgcccacagggaggcaggcacttttgcatccgctagcactctgctgcagttgccgcactttggtcccctcagtgcagtggaccccaaa

SEQ ID NO: 384007 - DNA, 254 bp, Homo sapiens
atttgtctgaaaaatatatttctacatgatctgataaagttcagataaggggcattctgttcctaagaatgtcctaaaaatggaaagctgataaaagattatgcttagaattatacaggtaaaagacctacaacagttgttctcttgttttgatcccataggttatttgttattactcttctttaacagagtgattttctattcttaaccttcttaagagccaatacagagtagaaagaaatattttcagaaag

SEQ ID NO: 384008 - DNA, 896 bp, Homo sapiens
tgctgatatcgtgagtacttattgtacaattactttatggacccctgcattctcttctaaatgggtgataggaaccctggacaagagcaaaaggctccgcactgaccaataatcctaatagcacctaacatttagtgaatgatcactatgacaatcctatgctaaaggttcaaccgtatgcagttgctatttttgcaggccaaatattggcagtttcaaagggctcaatcgaatacggtatctatcttaatttttttttattctaccatagtagaatgaggttttaacctcagttagagatgagaaaactgagacttgtggaggttagtgtcttaccaaggtcccacagctagtaggtggtggaagcaaggctgggcccatcctgctacatcccagagctgatgctttgaggcaccacaaggcaagggaagttggctgccctcgggtgctctcagtgtagttctgaagacacagccatgtctcaggaaactcccaaaataaacacaaaactgaatatatgcactactaagttggattcaatttcctgagacagtacaggaagccagcgtgtcctgttcaaagttaacagagaagaagcgcatagactctggaaaaaatctaacaatgcaacatcccttcagaacatcttgttattttcttgtacatttgctggccttggcctcgggccgtaattacattatcttcaaacagcaactagaaatattgctcattaaacatgaacacgggaatgtttaatttgttaggacgtaggtgttttgaaagcaaatcattggttcagggcattgaactgagtgctgccattggagttgtctttggtgaacaccatgtcctggccagaactttgccatgatgcgtgttcactgcagatgagagaa

SEQ ID NO: 384009 - DNA, 919 bp, Homo sapiens
tcacaggactatttgagtaattttccattatactctgcatggcccagagagatttaaagttaaagcagagtaccacttttgtaaataaaatgaaatcaaactctaacaattgtaaggcatgattttccaagcctccggggtttagggcaagtaactgctgccgtccctgccggctccaaccctgttggtctcctgaggcctggttctctgggttgtacatttcttttagaaccaccccagtttatttctgaccttgtgcccacatcccatagtcatggtgcagcatatatatttttttttttaataaccctggatgtgcaggtggtcatatttcctaaggtttcaataaagaatgtatctcagaacaccagggtaggaatggctcttaagtttgcactgggtgcttgaggtaagattaggcagacccagagggtagtggagactttgaccttatcatgaaactctttaaatatcataattttgaaaacataagatatgaggtatttcagagcagtactctattctctaggcactaaagatagaagtgaatgaagctcttttttcctgacttctcagcctcctcacaatcccttggtgagtggccctcttttggacaagtgcaggggctgagtgtggaggttgagtgtcatgtccacagacacatgtgacaggaagaagtattttgagcataagaacttggttcctggccgggcatggtggttcacgcctgtaatcccagcactttggaaggccgaggaaggtggatcatgaggtcgagaccatcctggccaacacggtgaaatcccgtctctactaaaagtacaaaaattagcgtggtggcgcatgcctgtaatcccagctactccggaggctgaggcaggagaatcgcttgaaccagggagttggaggttgcagtgag

SEQ ID NO: 384010 - DNA, 491 bp, Homo sapiens
ctgcggccgcgtgggtgggggtccggggtcggggggcggtgcgaggcccggcggcgtcggctgagggaccagcgggactggggcgaacccggcgtgggccgagccttggagctcgggcgtcgggtcaccgcgtcccgggactgaccacctgtccggtgcgccgctcagagaccggggtggccgcagcctccgccacttgcccttgactttacacttccgccgaagcctacgaacttgccaaccggaaacaaatgggaacgaattttgttcagcaactacaaaaggcagatgtgaaaagtagttgcagaacaattcggtgcccgctgccgctcgttgtgctgaggacgaacggcgctgcgggcctggctccctatggcggctccctgctcgcgcttcactccaaggggaacccacagaggttttggaggagttattaataaattgtcttttttggtgacaaaaaggaaaaagaaattggaacctcgtgccgc

SEQ ID NO: 384011 - DNA, 541 bp, Homo sapiens
  misc_feature (502)..(504): n is a, c, g, or t
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcagcattgtgctatatgtcccgagtgcccaacnnncgcctgggggtaccgagcgcgtgtgcgtacctcagtg

SEQ ID NO: 384012 - DNA, 5308 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttaacacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcggaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacggtgattcttaaaactttgctgttgatgattttaaatggagaaaatgagtacgtaagatgttatttcccagttcagtatataggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagtcaggagaaggtgagtggggtgaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttcttttttttttttttttttaagagatggggtctcgttctgtcatgcagactggagtgcagtggtgtgatcacagctcattgtaacctccaacgcctggactgaagtgatcctcctgccttggcctctctggtagctgggactacaggtgcatgccaccacacccacctaattttttttatttttattttttgtagagacagtctcactatcttgctcgggctggtcctgaactcctgggctcaagttatcttgctgcctcagcctcccatgggtaatctttatttccttttttttttttttttggagatggagtttcgctcttgtcgcccaggctggagtgcaatggcacgatcttggctcactgcagtctccacctcctgggttcaggtgattctccatcctcggcctactgagtagctgagattacaggcaactgccaccatgcgcggctaatttgtgtatttttttttagtaagagatggggtttcgccatgttggccggactggtcttagactcctgacctcaagcgacctgcctgccttggcctcccaaagtgctgggattacaggcatgagccgctatgcctcgtcgctgatttttatttcttattttttttttagagatgggggtctcactatgctgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatattgcaccactgcactccagcctgggtgacggaacgggactctgtctcagaaaaaaaaaaaaagaagaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgtttcgctgcacacaaaaacaaaagatataaaaatggatcataaacatttttctaaatcctgaaaagtgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaaaaaaaaaaca

SEQ ID NO: 384013 - DNA, 5196 bp, Homo sapiens
  misc_feature (13)..(13): n is a, c, g, or t
  misc_feature (52)..(52): n is a, c, g, or t
ggtagctggctgngcctggcgcctcctgcgccgccggagctttgctgctggnccgtgataaatgattttgggatttctgaagtgggagtgagttgcagcttaatggcagagaatccagggaatgcagcttagcccacagttgccctttgatgaggagccttcactaatgttcatctttctgggtgacagcctctctctcacctgagcctacagtaactctgcaagtagtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttaacacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcggaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacggtgattcttaaaactttgctgttgatgattttaaatggagaaaatgagtacgtaagatgttatttcccagttcagtatataggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagtcaggagaaggtgagtggggtgaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttcttttttttttttttttttaagagatggggtctcgttctgtcatgcagactggagtgcagtggtgtgatcacagctcattgtaacctccaacgcctggactgaagtgatcctcctgccttggcctctctggtagctgggactacaggtgcatgccaccacacccacctaattttttttatttttattttttgtagagacagtctcactatcttgctcgggctggtcctgaactcctgggctcaagttatcttgctgcctcagcctcccatgggtaatctttatttccttttttttttttttttggagatggagtttcgctcttgtcgcccaggctggagtgcaatggcacgatcttggctcactgcagtctccacctcctgggttcaggtgattctccatcctcggcctactgagtagctgagattacaggcaactgccaccatgcgcggctaatttgtgtatttttttttagtaagagatggggtttcgccatgttggccggactggtcttagactcctgacctcaagcgacctgcctgccttggcctcccaaagtgctgggattacaggcatgagccgctatgcctcgtcgctgatttttatttcttattttttttttagagatgggggtctcactatgctgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatattgcaccactgcactccagcctgggtgacggaacgggactctgtctcagaaaaaaaaaaaaagaagaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgtttcgctgcacacaaaaacaaaagatataaaaatggatcataaacatttttctaaatcctgaaaagtgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaaaaaaaaaaca

SEQ ID NO: 384014 - DNA, 4906 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttaacacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcggaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacggtgattcttaaaactttgctgttgatgattttaaatggagaaaatgagtacgtaagatgttatttcccagttcagtatataggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagtcaggagaaggtgagtggggtgaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttcttttttttttttttttttaagagatggggtctcgttctgtcatgcagactggagtgcagtggtgtgatcacagctcattgtaacctccaacgcctggactgaagtgatcctcctgccttggcctctctggtagctgggactacaggtgcatgccaccacacccacctaattttttttatttttattttttgtagagacagtctcactatcttgctcgggctggtcctgaactcctgggctcaagttatcttgctgcctcagcctcccatgggtaatctttatttccttttttttttttttttggagatggagtttcgctcttgtcgcccaggctggagtgcaatggcacgatcttggctcactgcagtctccacctcctgggttcaggtgattctccatcctcggcctactgagtagctgagattacaggcaactgccaccatgcgcggctaatttgtgtatttttttttagtaagagatggggtttcgccatgttggccggactggtcttagactcctgacctcaagcgacctgcctgccttggcctcccaaagtgctgggattacaggcatgagccgctatgcctcgtcgctgatttttatttcttattttttttttagagatgggggtctcactatgctgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagtaaatattatctatctccattgcctgttaagaaatgtgctagtagaagtgtgagggcagggtgtcagtgttctctcagcctcttccctcagatactcgtctgcttaccaaaataagttgcatgtccttgacaatctggtttctatgattggtgaggctggcatgctattacctttatgtgccctgtagacttgaatgaccagtttgaccagtttgactgttagataatcagaaggcttttctctttttttataatagaccccatctcaaatcagataatgaaaattacatatcttgaactcctgacctcaagtgagctgcctgcgtcgggctcccaaagtgctggcattacgggcatgagccatcgcgcctggccagtgacatggtttttaagtctccttgaatctcctctcaaaaactgagcaagcctgggcaacaaagtgggactcctatctctctttttttttgttttgagacgaagtctcgactctggcctgggcaacagagtgagaccttgtcctaaacaaccaaccaaaaaaaccagagcaactaggtagcaaagccaagaacccacaggcagcatttacaacaaaactggttagtttccttactacaagc

SEQ ID NO: 384015 - DNA, 1805 bp, Homo sapiens
ttgcactgtcacccaggctggagtgtagtagtgtaatcatagctcacagcagcctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatattgcaccactgcactccagcctgggtgacggaacgggactctgtctcagaaaaaaaaaaaaagaagaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgtttcgctgcacacaaaaacaaaagatataaaaatggatcataaacatttttctaaatcctgaaaagtgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaaaaaaaaaaca

SEQ ID NO: 384016 - DNA, 1593 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcagggcatgcttcatcttctcagaggttttcaaagctgcccacagcccagccctaagcctacctcgcattactctgcaagaagcctctttgctcagagattagaactgcaatgttcatgagaggtcacctactcatccctttcactgaagaagtggggaaaacaaggctcagacagggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaaaaaaaaaaaaaaaaaaaaaaaaaaaaaaaaaaaaaaaaaaaaaaaaaaaaaaaaaaaaaaaacaaaacaaaaaaaaaaagacaaaccagcgaaaacagacacggaaacaacaaaagagcacaaagaaaaagaaacaccacgcgaaccgggcgagaggcagaagagggagcggaaggagagaaaaagggccagaaagcgacacagcgcggaacaacccgcggacacacaagaagaggaccagcgagaccca

SEQ ID NO: 384017 - DNA, 1096 bp, Homo sapiens
tcacaggactatttgagtaattttccattatactctgcatggcccagagagatttaaagttaaagcagagtaccacttttgtaaataaaatgaaatcaaactctaacaattgtaaggcatgattttccaagcctccggggtttagggcaagtaactgctgccgtccctgccggctccaaccctgttggtctcctgaggcctggttctctgggttgtacatttcttttagaaccaccccagtttatttctgaccttgtgcccacatcccatagtcatggtgcagcatatatatttttttttttaataaccctggatgtgcaggtggtcatatttcctaaggtttcaataaagaatgtatctcagaacaccagggtaggaatggctcttaagtttgcactgggtgcttgaggtaagattaggcagacccagagggtagtggagactttgaccttatcatgaaactctttaaatatcataattttgaaaacataagatatgaggtatttcagagcagtactctattctctaggcactaaagatagaagtgaatgaagctcttttttcctgacttctcagcctcctcacaatcccttggtgagtggccctcttttggacaagtgcaggggctgagtgtggaggttgagtgtcatgtccacagacacatgtgacaggaagaagtattttgagcataagaacttggttcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaaaaaaaaaaaaaaaaaaaaaaaaaaaaaaaaaaaaaaaaaaaaaaaaaaaaaaaaaaaaaaaacaaaacaaaaaaaaaaagacaaaccagcgaaaacagacacggaaacaacaaaagagcacaaagaaaaagaaacaccacgcgaaccgggcgagaggcagaagagggagcggaaggagagaaaaagggccagaaagcgacacagcgcggaacaacccgcggacacacaagaagaggaccagcgagaccca

SEQ ID NO: 384018 - DNA, 424 bp, Homo sapiens
ccactttgtcatgaccaagttggtctctgctcagataatctcactgccttccaattatattttatagggcatgcttcatcttctcagaggttttcaaagctgcccacagcccagccctaagcctacctcgcattactctgcaagaagcctctttgctcagagattagaactgcaatgttcatgagaggtcacctactcatccctttcactgaagaagtggggaaaacaaggctcagacagggtgagtaccttgaccaaggccacaaaaattagtgtccatgcaggaattggaaccaaggcccttttcatctcagttcagtggtttttttgtttttgttttgttttgtttttagagatggggtcttgttcggtcacccaggttgcagcctggaactcctgggctcaagcgatcctcctgcctcag

SEQ ID NO: 384019 - DNA, 5865 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttaacacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcggaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacggtgattcttaaaactttgctgttgatgattttaaatggagaaaatgagtacgtaagatgttatttcccagttcagtatataggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagtcaggagaaggtgagtggggtgaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttcttttttttttttttttttaagagatggggtctcgttctgtcatgcagactggagtgcagtggtgtgatcacagctcattgtaacctccaacgcctggactgaagtgatcctcctgccttggcctctctggtagctgggactacaggtgcatgccaccacacccacctaattttttttatttttattttttgtagagacagtctcactatcttgctcgggctggtcctgaactcctgggctcaagttatcttgctgcctcagcctcccatgggtaatctttatttccttttttttttttttttggagatggagtttcgctcttgtcgcccaggctggagtgcaatggcacgatcttggctcactgcagtctccacctcctgggttcaggtgattctccatcctcggcctactgagtagctgagattacaggcaactgccaccatgcgcggctaatttgtgtatttttttttagtaagagatggggtttcgccatgttggccggactggtcttagactcctgacctcaagcgacctgcctgccttggcctcccaaagtgctgggattacaggcatgagccgctatgcctcgtcgctgatttttatttcttattttttttttagagatgggggtctcactatgctgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagtaaatattatctatctccattgcctgttaagaaatgtgctagtagaagtgtgagggcagggtgtcagtgttctctcagcctcttccctcagatactcgtctgcttaccaaaataagttgcatgtccttgacaatctggtttctatgattggtgaggctggcatgctattacctttatgtgccctgtagacttgaatgaccagtttgaccagtttgactgttagataatcagaaggcttttctctttttttataatagaccccatctcaaatcagataatgaaaattacatatcttgatatattagaaaagtatatacattctggctgggcacggtggctcacgcctgtaatccctgcactttgagaggctggggcggatcacttgaggtcaggagtttgagaccggcctggccagcgtggcgaaaccccatctctactaaaaatacacagattagcccggagtgatggtgtgcacctgttgtcccagctactcaggatgctgaggcaggagaatccctttaacctggggggcgaaggttgcagtgagccaggattgcaccactgcactccagcctgggtgacggaacgggactctgtctcagaaaaaaaaaaaaagaagaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgtttcgctgcacacaaaaacaaaagatataaaaatggatcataaacatttttctaaatcctgaaaagtgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaaaaaaaaaaca

SEQ ID NO: 384020 - DNA, 548 bp, Homo sapiens
aggtgacttagaggatccccaggcgctggaggcagagcctagggctagcggcatgtcatcaggtactcacaggttgactgcagaggagaggaaccaagctatacttgaccttaaagcagcaggatggtcggaattaagtgagagagatgccatctacaaagaattctccttccacaattttaatcagcatttggctttatgtcccgagttgcccaacaagcgcctgccaggcgcttgttaggcgcttgttggaggaagacagtgaatacctaagtcacaactgtaaacataaatggaggaaggggcttggggtccccatgacatcatcccccctcttttaagctagctgagggcccccagtccccagcacagtgtgagagaagaagcagggtgtcagacaccttcctgggcctacggggagccaggggccttggaagattaggttggcgcactctgctcaggactgagagcaatcacaccccaggacccagcgaggtcagctgtgtgctccccagattggaatcgtgcccaggccaacaagcgcctgg

SEQ ID NO: 384021 - DNA, 1419 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaaaaaaaaaaaaaaaaaaaaaaaaaaaaaaaaaaaaaaaaaaaaaaaaaaaaaaaaaaaaaaaacaaaacaaaaaaaaaaagacaaaccagcgaaaacagacacggaaacaacaaaagagcacaaagaaaaagaaacaccacgcgaaccgggcgagaggcagaagagggagcggaaggagagaaaaagggccagaaagcgacacagcgcggaacaacccgcggacacacaagaagaggaccagcgagaccca

SEQ ID NO: 384022 - DNA, 4998 bp, Homo sapiens
ggcctacggctgtggggcgcgcagagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttaacacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcggaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacggtgattcttaaaactttgctgttgatgattttaaatggagaaaatgagtacgtaagatgttatttcccagttcagtatataggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagtcaggagaaggtgagtggggtgaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttcttttttttttttttttttaagagatggggtctcgttctgtcatgcagactggagtgcagtggtgtgatcacagctcattgtaacctccaacgcctggactgaagtgatcctcctgccttggcctctctggtagctgggactacaggtgcatgccaccacacccacctaattttttttatttttattttttgtagagacagtctcactatcttgctcgggctggtcctgaactcctgggctcaagttatcttgctgcctcagcctcccatgggtaatctttatttccttttttttttttttttggagatggagtttcgctcttgtcgcccaggctggagtgcaatggcacgatcttggctcactgcagtctccacctcctgggttcaggtgattctccatcctcggcctactgagtagctgagattacaggcaactgccaccatgcgcggctaatttgtgtatttttttttagtaagagatggggtttcgccatgttggccggactggtcttagactcctgacctcaagcgacctgcctgccttggcctcccaaagtgctgggattacaggcatgagccgctatgcctcgtcgctgatttttatttcttattttttttttagagatgggggtctcactatgctgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatgaggaacgatgatgaatgtcgggcatttgtgaagagagtcataatgagccgtttctttaagataattatgattagcactgtcacatcgaatgcgttttttatggccttgtggaccagttatgacataaggtaccgcttgttcagacttcttgagttctcggagatcttctttgtgtccatctgcacatctgagttgtccatgaaggtctatgtggaccccatcaactactggaagaacggctacaacctgctggatgtgatcattatcatcgttatgtttttaccctatgccctccgccagctcatgggcaaacagttcacttacctgtatatcgctgatggcatgcagtccctgcgcatcctcaagcttatcggctatagccagggcatccggacgctgatcaccgccgtggggcagacagtctacaccgtggcctctgtgctcctcctgctcttcctcctcatgtacatcttcgctatcttgggcttctgcctgtttggatctccagacaatggtgaccatgataactgggggaacctggctgcggcttttttcaccctcttcagcttggccacggttgatggctggacagacctgcagaagcagttggacaatcgggaatttgctttgagccgggcattcaccatcatcttcatcttgctcgcctctttcatcttcctcaacatgttcgtgggtgtgatgatcatgcacac

SEQ ID NO: 384023 - DNA, 717 bp, Homo sapiens
cgttgggactttccctctcagacatttattggttcattcattcgttcattttgctgtaactcacagtggcccccatcctaaggtgcactgctgggattggtctatgtgctgatgatgttctccttgtcttcagagtagagacggagtttcaccgtgttagccaggatggtctcgatctcctgacctcgtgatccgcctcgtgatcctcctgatcctcgaagccgcccgcctcggcctcccaaagtgctgggattacaggcgggagccaccgcgcctggccgttccctgggtcttttgagtggtgtgagttgaatggtggtagattctaggacagttcagtaggagcccgtcctcaaaaggaaaataacagaacttcctgctaatctggtattggggctgagcaattactgcacactgatgagattgaccataattgcatcctgagtttgaagaggaggtcacgctactaagacgagataaaatcagctccaacgacaaacatcatctctgggggtttccagattctcaattttcatttaatccccagccttagtggaaagcaagagtcggagtcggcattctgggcagggaggcaggtgaggcaggtacacatctcctcttctccccaacgccccatgtttctatttctgaataaaatgaaccatcatggtgctaaggtaaagctaaactagctgagccacctcctgaagaggacat

SEQ ID NO: 384024 - DNA, 764 bp, Homo sapiens
agcggacggggtcgagtcagtgccgtttgcgccagttggaatcgaagcctcttaaaatggcagatgatttggacttcgagacaggagatgcaggggcctcagccaccttcccaatgcagtgctcagcattacgtaagaatggctttgtggtgctcaaaggctggccatgtaagatcgtggagatgtctgcttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtaccagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccaaggtggcagtggtggcagcagtgatcctccgaacctgcagaggccccctcccccagcctggcctggctctggcctggtcctaggttggactcctcctacacaatttatttgacgttttattttggttttccccaccccctcaatctgtcagggagcccctgcccttcacctagctcccttggccaggagcgagcgaagccatggtcttggtgaagctgccctcctcttctccc

SEQ ID NO: 384025 - DNA, 551 bp, Homo sapiens
ttttaaaatatttaagtatcagagaaagtcattttaacagagaaaaatcaaaatcatttcaggctgcaacaaatttctatagaataactgtatcagtatttcaaccaatatacatgtcttgactgaaagctataaactggctcactgcaacgtccacctcccgggttcaagtgattctcctgcctcagcctcctgagtagctggaattacaggcacacaccatcactcctatttttttttgtattcttggtggagacagggtttcactgtgttggccaggctggtcctgacctcaagtgatccacccatctcggcctgtaatcccagccccctgggagacagggcaggcagatcacctgatgtcaggagtttgggaccagcctggccaacatgatgaaactccatctctactaaaaatacaaaacttagccaagcatggtggcaggcacctgtaatcccagctacttgggagcctgaagcaggagaatggcttgaacctgggaggcagagtttgcagtgagctgagaacaagccactgcactccagcctgg

SEQ ID NO: 384026 - DNA, 1123 bp, Homo sapiens
ttttaaaatatttaagtatcagagaaagtcattttaacagagaaaaatcaaaatcatttcaggctgcaacaaatttctatagaataactgtatcagtatttcaaccaatatacatgtcttgactgaaagctataaactggctcactgcaacgtccacctcccgggttcaagtgattctcctgcctcagcctcctgagtagctggaattacaggcacacaccatcactcctatttttttttgtattcttggtggagacagggtttcactgtgttggccaggctggtcctgacctcaagtgatccacccatctcggcctcccaaagtgctgggattacaggcatgagccactgagcccagccagacttttcaatgtttaagtggatttttttcaccctctaaagttttaaggaaaagttattaatctttaaatgtaaaaacattcatgagtcccaagcatagcaatatttaggcatattctgttctaggaaagaataaagcagagacttgaccaagatagggatgtcatcaattcaggaaacattatcaagcaaatatggaaagtagaaatcaaataactgtttttctcattaactttcaccctgttcttccctggtatgttggcaattccctgcgcatgctaagaaaaaaaaaaaaacagtcacaaagctttgttattcaaagcttggtgttatgtacaagtctgagaattggcttttggaaaaaaatttatgatgaccaaataaaatgtaccattttaatgaagtctgtggacaaggttcaattagattggttattttaaaatgattcattgattattttaaactgattacttaaagaaaaatatcaaaaagtatacagttttaaggccgggcatggtggctcatgcctgtaatcccagccccctgggagacagggcaggcagatcacctgatgtcaggagtttgggaccagcctggccaacatgatgaaactccatctctactaaaaatacaaaacttagccaagcatggtggcaggcacctgtaatcccagctacttgggagcctgaagcaggagaatggcttgaacctgggaggcagagtttgcagtgagctgagaacaagccactgcactccagcctgg

SEQ ID NO: 384027 - DNA, 2088 bp, Homo sapiens
cctctgggctgccatttgcagggaatttcatgtacatattcagacatgcagacttgcacaactgcttattatagaaatattctttgttactaagtgtctaacagacttaaacatacagggtttccgtatatggagaaaagtgattccacccactccatgccctggcacgtcatgatgccagcccttagatttatttggcttccagaatttaaatagacagtgatgtaaatcagaagttagtgtttcacctactggcactaagtaactaaatcatcacattggtgatgaggaaggtaaatccttttcagtttggctacagaatggaaataacatttattacaatatgatctaagttatattgacaacagaatgatttatttctatgttataaaagatgaagaaggagaggagaatacagagaagttaaatggtttggcagtgatcacacaacaagccgaaagtagaatccaagtctctctggagtcccttctctgatcaaagtttcatcttattgaatgtcacagcattataaagtgagataaatgtatctcaccacacatgtgcttagtgaattattctcagtagatagcttcttctatttttaaacattttgttctgagattttaaaatttcaattctattctcttatgttttaaaaccgtgttcacagatttgagctaaaatgggaatcgaagagtgactttggcatttttccatgactattcttgtattgatcttaaactggcatcacacgtgttccaggagggcacttgttttgcacaacagttttacaaactagctgtctataagaggcagttcattaaaatttaatgtttttaaatgatctttagatgtatagaattttttaaagactacatattagagaaagcatgcatacaaaatatttttttttttgcccagtagtggtgataatagctaacatttattgaactcttactctgtaatagccactgttccagtgattaactctttattttaattttttttaattttatttttattatatattgacaaattacagttacatatttatggggtgcaaagtggtgttaagattttttaatacaatgtggaaagattaagttaagctagttagcatatccatcacctcgatatttaacattttttgtgacgagaacattagagatttactgttagtgatattgaaatgtatataacaattatattcaccatgctgtgcaattgatctaaaaaaggatcaaacttattcttcctgcctaactggggctttgtaccctttgactgtaatctccttttccccgctacccccttggccgctggtaaccaccattctactgtctacttctatgagtttagtcgtttttcaatgcaatctctataaaaattccaatgccatttctcatacatatagaaaaataatcctaaaatttatataaaaccacagagaaacccaagtagccaaggcaattgtaagcaaaaaagaacaaagctggagcattacactactagatttcaaactactgtattctataaaatgatagtaattagaacacattgtacagtataaaaaaagacacattgaccagtggaacagggtagagagcccagaagagaacccatgcaactgtggtcaattgatcttcaacaaatgtatcaagaatatacagtaggaaaggacagtgtcttcaataaatggtgtttggaaaattggatatccatatgcaaaagagggaaatcgaacccttacctcacaccacctacaaaatcaaatcaaattggattaacatcttcagcataagacctgaaactgttaaactactggaagaaaacataggagaaaagctaaatgacattgtgtctggacaatgatatttatagttattaaatatttttatttaaatcctcaaaacaactctatgagatattattattcccattttatggataaggaaactgatgtacagagtgattaaatgacttgctagaggctaggtgcagtggcccatgcctgtaatcccagcactctgggtggaaggatcgcttgaggccaggagttcaagaccagcttaggcaagactctgtctc

SEQ ID NO: 384028 - DNA, 709 bp, Homo sapiens
  misc_feature (3)..(3): n is a, c, g, or t
  misc_feature (234)..(234): n is a, c, g, or t
  misc_feature (696)..(696): n is a, c, g, or t
ggncaaggttttgccatgttggtcaggctcgtcttgaattcctgacctcaggtgatccacctgccttggcctcccaaagtgccaggattacaggcgtgagccaccacacccggctggaagactgtttctaaagtcagacaaaggatagactaaatgtgttttctgagaaacgttagtctagggaatctgagaggccagaacctctatcatgagtaaaagaatcatggctcatantctctagttttcatctcatactgttgacttctaatcgagttccttgttttagtaacaaataaaataaatgttttctgctctcaaatctacagggactttattaaaattggaggaacaacatttgacagtcttttgaacgtttagaaaaataggatttattgtggctaagtctaaaaggtctcatgattacaattgactgaaaaggaaggaatgcattgctttccatgcgtggtgacttaattttatgtgcagtactatgcaatacacagagacttacctaactgctgttcttggagggtctattaggcattaaagtgtaagtatccctattgttatttacactaggaaaaaaagcatacctcaggtctttgagaatccaggaaagctttgttttagaatattgctccagcacttgcagtgagccgagatcccgccactgcactccagcctgggcgacagagngagactctgtctc

SEQ ID NO: 384029 - DNA, 2303 bp, Homo sapiens
  misc_feature (2187)..(2187): n is a, c, g, or t
  misc_feature (2303)..(2303): n is a, c, g, or t
atgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaaaaaaaaagaactaattttgnaaaccatgttggccggctcggccaaatgatttttgattgagcaaggttttgcttggggcgcaatttaagctcctttggcaattcccctttagtgagggggttacaaataacgggcn

SEQ ID NO: 384030 - DNA, 1120 bp, Homo sapiens
taggctagtacgaggcctggtggtgtggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaa

SEQ ID NO: 384031 - DNA, 2167 bp, Homo sapiens
atgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacaaaatcactgctgcgatcttttattccatcagcttgacccagcagggactccaaggggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaa

SEQ ID NO: 384032 - DNA, 2113 bp, Homo sapiens
atgcgaggcttcgggccaggcttgacggccaggcgtctcctcccgctgcggttgcccccgcggccgcccgggccccggctggcgagcgggcaggcggccggcgccctggagcgggccatggacgagctgctgcgccgcgcggtgccgccgacgccggcctacgagctgcgcgagaagacaccggcgcccgccgagggtcagtgcgcggacttcgtgagcttctacggtgggctggccgagacggcccagcgggccgaactgctgggccgcctggcgcggggcttcggcgtggaccacggccaggtggcggagcagagcgccggcgtgctccatctgcgccagcagcagcgggaggcggcggtgctgctgcaggccgaggaccggctgcgctacgcgctggtgccgcgctatcgcggcctcttccaccacatcagcaagctggacggcggcgtgcgcttcctggtgcagctgcgggccgacctgctggaggcgcaggccctcaagctggtggaggggccggacgtccgggaaatgaatggggtgctgaaaggaatgctctcagaatggttttcctccgggttcctgaacctagaacgggttacctggcattcaccgtgtgaagtgcttcagaaaatcagtgaggctgaggctgtgcatcctgtaaaaaactggatggacatgaagcgccgcgttgggccctacagaaggtgttacttcttttctcactgttcgacccctggggagcccctggtcgttttgcacgtggcactgactggtgacatctccagcaacatccaggcaatcgtgaaggaacatcctccatcagaaacagaagagaagaacagggtggagctgggaacattcctcataaagcgagtcgtcaaggagttgcagagagagtttcctcaccttggggtgttttcaagtctgtcacctatacctggtttcaccaaatggcttctggggcttctgaactcgcaaacgaaggagcatgggaggaatgaactctttacagattcggaatgtaaggaaatctcggagatcacaggtggccccattaacgagaccctcaagctcctcctcagcagcagcgagtgggtgcagtcggagaagctggtgcgggcgctgcagactccgctgatgaggctgtgcgcctggtacctgtatggagagaagcaccgcggctacgcgctgaaccccgtggccaacttccacctgcagaacggggcggtgctgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaa

SEQ ID NO: 384033 - DNA, 1008 bp, Homo sapiens
atgcgaggcttcgggccaggcttgacggccaggcgtctcctcccgctgcggttgcccccgcggccgcccgggccccggctggcgagcgggcaggcggccggcgccctggagcgggccatggacgagctgtgtggcgcatcaactggatggcggatgtgagcctcagaggcatcaccggctcctgcggcctgatggccaactaccgctacttcctggaggagacgggccccaacagcacctcctacctcggctccaagatcatcaaagcctctgagcaggtcctcagcctagtggcccagtttcaaaagaacagcaagctctgacagtaaacctctcctaaagcacagggccccggctaagaaaacgatcattttcaggaggggccgggagttatgtatctgaagcagctttccaagcaaagccaaagttgactgtgttcttgtcccgcagccggtccacactgtgaggccaggcctcaacttccctcaccctgggcgtgacatgcacccagtgcaagacggttgtgggtgcgggtgcacacaaatgagtgggttgctgtgctgtctccggaagattctgtcgttgcccttggcctggctccctgcccggggctggtgctgtggtacctacatcttcaggaagctgtgcagcctctgccattgccatcccagggggatctggcatcctcctaaggaccggggcgcgtggcccagataagaataggtgttcctttgtgctcataaaacagaatgcggcgatggttgctttagccgtttctcaccatgcaatgcagagggacaaagggctgtgctacacttcccagttacattctgaagctcataaatgtatgagaaggtttgtgattttgcacaaggtgtgtgtagtaagttaaattgttgaacacaaaaatgttgctgcttgaggcataagttggataataggctttaaatgatcagggattcaggttcataatgaacttcacagtaaagaacacgtttgttctgtaaa

SEQ ID NO: 384034 - DNA, 591 bp, Homo sapiens
tggtacctgcctgtgcctgcacctgacactcaggcctctggggaggcccgtagagatactggcaaatctgaggcaagggcagggttgagggacactgcaggctaacaccatgcagattttaggaaccacatggtaaaatgaaaaatggaaaccagtgtcccattagggatccaactgtcaaattatttgaagtttgtgtgtttgaaaaaatgattaaaaggtgatgggtacatggtagtcattataccattctctctgtatttatgtatatttgaaaatttctgtaataaatttctaaaaatggtaagtatgttctctaacacatgcccttactcttgttacatcgggggtagaggcagaaattcagggatggattcagaaagaactgagacacagttaccagtctccatctccaatcagttaagcacagcaattcaaatcataggagaatgggacgcgcactggccacattctaaggttacatgtgaggggagtctcagcagaccttcaaggagtcctaagaataacgtggcaacagcaaactaaattctgcatgtttgtacgtataagtgggagctaaacattgaatac

SEQ ID NO: 384035 - DNA, 453 bp, Homo sapiens
tgaaatgtgagatgcaggggaaaaaatgaaatgaagactttaaagtggacgtggccaatttacttatgaatttttagctccatcacttattaactgtgtgattttgggcaagtcacttaatttctgtgaacgtagttttttctttgtaaaattgagacaataatagctctcttacagggttgttttgaggacattaatatatataaatgtaggggaaaagaaatatttttcccattgctatgttcatggctgaggctcctgtagcaaaagacattaacgagagaggtcgggcgtggtggctcacgcctgtaatcccagcactttgggaggccgaggcaggcggatcacctgaggtcaggagttcgagacagcctgaccaaaatggtgaaaccccgtctctactaaaaatacaaaaaattagccgggcgtggtggtggcgcctgtagtcccagc

SEQ ID NO: 384036 - DNA, 407 bp, Homo sapiens
ccattctttatgaaataggaaaatgacactctaagaagttattctttatggcttggggaaatgaaaaaagagaaaccgtattagataaaatatttccatcacaagacaccaaatattcatcatcccttgtgttctaacatgacttaatttttttattattattattatttttaaatcttttcatatacgttgaccaggctggtctcgaactcctagcctgggcaatatggtgagaccccatctttataaacatttaaaaattagccatgcatggtggtatgcatgtatagtcccagctacttggctgaagtgggaggatcacttgagcccatgaagttgaggctgcagtgagccataatcacaccactgcactccagcctgggcgacagagcaagacactgcctcaa

SEQ ID NO: 384037 - DNA, 352 bp, Homo sapiens
ataaacatgacatggtatagtagaagatggtaagtgctatggggaaaaatgcaacagagtaaggaggattatatgttgtgaaggggcagagggaagtgctggttgtaattttattttatttttccgtccattacttatcagtctcagtacttgtgagtttaaatagagtggtcagggtagatctcattgagatgaaaagaaggaattaaccaagcagatacctatgtaagtgcattctgtgcagaggccttaaggaaggatgatgcttgtgtgtacatgggaaaacaaggaggccgtggaggctggagcacaagagagtattaggagtagaggtcagatcatgcaggacctt

SEQ ID NO: 384038 - DNA, 3729 bp, Homo sapiens
acttaatggttaaaaagcaatgataaaactggacattaatgaaattgatttttagttacagttggaataagttttttaccaaaaagaaaccagagacgttagttaaggagacttaaaaagatctgaaatatgaaaagagaatgagaagatgagcagaagataaatttgtgggacacaagtataacttggggtagaaactggagaagagaatcgaaaaacaataatgccagaaggacccttggtatgaaagtactaatggaatgtgattcatagaaagttcatagaaagtgagtccttgcaacttgagaaacatacatacatatatatttataatctctaaagcaacatcaggaatcttctaatatatgataaagaatttgtgtagaattacgttgttcacagtattattggagagacaaataagatttcaaggaattcatttataatcaaaagtgaaatgtgtcttcttgaaaccagcaagaaatagatgaattgagtgaaacgtgttgttattaggagaagtgggataacgtatacaaaaagaacttgcgatctgaatatgatctgaatatgagggtggataggaattttttgacagtgaaatctgttatgatgtagtctcatttccaagaaaagtcttgagttccatccccccttctgaatttaaattgaaacctggacagaaaacaaactatcctgtagtttccactgctcaggaggaaaaaaagaaatctatattatctaatgcatctttgccatctttattttctagaattctattagacttttcaattataggctattaggaaagaatataactcttagaattcccctaaatataattatcaactcatttgattaatatgcatattttttcccgtaagatttacaatacacgtgtgttttagtgaattaccaatggcttggagagaatgaaattggaataactaactgaaaaccctagatgtttgtagcattgagacccaatatctttttggaggccctctccatgttagcttattgtcaaattctggtgtgtaaacaaactccttgacccatgttaagttcagcatcctgcattttgttcatgaatcacattttaaaaggagaaaagctcctaagtttttttaaacagtgatttcaaagagaagataggcctttcataattgctaattatacatataggattaatagtcataaattatagtaaataaaacttgtacctattccttttataaatatgaattggctaggcacagtggctcacagctgtaatcccagcactttgggaggctgaggcgggcagatcacaaggtcaggtgtttgagactagcctggccaacatggcaaaaccctgtgtctactaaaaatacaaaaattagccaggcgtggtggcaggcacctgtaattccagctactcaggaagctggggcacgagaatcacttgaaccctggtggcagagtttgcagtgagctgagattgttccactgcattcctgggcactgcctgggtgacagaatgagactctgcctcaaaaaaaaaaaaagttattaaaaatagatatttaagattccaaaatgtagttgatccagtttgtttccctgtagcaagtagtgggatttgggtttcatgacatataattaaaatgttaatcacataactataatgccaacaattttctttatacatttttgtttaattatgttgacatatactttgtgttgtaccttatttcatgttactaaattttacataaagatgctggtctatttttatttaatcatatactgttatggtttgaatatagtttgttcctaccaaaactcatgttgaaattagattccccatgtgctagtgttgggaggcagagcctaatggaaggtgtttgggtcatgggggcagatagatcccacatgaataaactaatgccctcctactggggtgagtgagttctcattcttgctgtcgtgggaatggattagttctcacaagcaagggttactaaagagtctggctttcttgattttctcctttttgcctcctgccttcccatgtgatctctttgcacatacctactcccctttcactttgtaccaagagtggaagcaacatgagaccctcaccagatacagctgcccaatcttgagccttccagccaccagaatcatgagccaaataaaactctttttaaaaataagttacccagtcttagatattctattatagcgacacaaaatggactaagctgtactctgttgcattaaaatgtgttgtttatatgcaagtgacaaaaactcaaaatagtgtcagcatgaagggcagttcattggcttatatacagggaagtccaggcaatgactgggtcctgggtccaaacgtcaaaagcagtcatcttgccatcctacacacttggctctgattattttcttctttatggattggttttcttttcagattttccctttggggatattctgtatgggatgaggaacagtgaggtgagaggatggtggataacagcaattgacattttcagcttaccttagcataacaaggctgaaagcttttataaagcaagctatgtaaaattttggagaagtacttttattttgcccagattggatcacattccgttcctgagctaatcaagagaggaattcacccaaaggagggggaaatttttagaagaaagccagaatgtagggagcaggtgaggaaaggtagttactgggaatacgaaagtaacacattcattgcaccctgtttgaatttgagtagcaagaagtttctgatttgtactaacagaaggagtaaagttcagatttaatctgcaagtcttgattgtttttaactagagattttaatctcttcttcttattattgctgctttgagttgccattataggtttttggattttttttttaatgccatccatttttatttgacatcatgttgttgctagtttgagcagatgcacatagcatatgtttccattaccaatttggaaatttttcccagtggcatcagcatttgagagatactgattttgaaattagagtactaggggaaaatgcttcaaaaatgaagactacttaaataaaaattggctttaaataaacctttggggatctgtacttgactaaaaagtattttctttaaactttggtctttgaaaactaaagtgtgtgtgcatgtgttcattaaaatgacctataacatgaacattttccatactggagtgtgatgtactgtactcattttgaactttagaaccaaatgcatcctttagcatttgatgagctgctatataattctatttccagttttattttcttgccaaataaagtaccaaagctcagcctgatatttggtaacccctgacttggtcccaacctaattttacagcttgcttactctctcattcactctccttttcaaactgcttcagtcacataaaacatcaaggaccaatttcattctgcatgtgggtatacagttttcccagcatcatttattgaagagattattttttcctcattatgtcttggtagccttgtcaaagatagttgcatgggtttatttctgggatctaatctgttcctttggtctatgtgtctttttatggagaacaatgctgttttgattactatagctttgtaatatattttgaagttgggtggtgtgatgccttcagcttgttctttttgctttggccactcaagctcct

SEQ ID NO: 384039 - DNA, 952 bp, Homo sapiens
gcgctcagcccgttgccgcgccggccctgcggacgtgcgcgcgctgccttcgcggcacctgggcctgaggtgcgtgcctcccgggccctcgccagctccagatgcgtgaggaggacttcagaaacccgactgagaagtggagcgacccccagggagggtcggacctgcctcaataccgccaaggtctttcatttcttgttcgcttactttcgtgaaatcctcacatcgttttaatggtactagtcaagacaagaaaatcaacaggctttcagccttgaggcaacattggatattattgagacatctgtggaatttaagaacagtatggagctcatcagagtatatcattgaagaatatgatggctgaaaacaatttaaaaatgctaaagattcaacagtgtgtggtagccaacaaactacctagaaacaggccatatgtttgcaatatttgttttaagcactttgaaacaccatcaaaattagctaggcactatctcattcatactggtcaaaagccatttgaatgtgatgtgtgtcataaaacctttagacaactagttcatctggagaggcatcaactaactcatagtctgccttttaaatgtagtatttgtcagcgtcactttaaaaatctgaagacatttgtgaagcaccaacaacttcacaatgaaacctatcagaataatgttaaacaggtcagaagattgctggaggccaagcaagaaaagtcaatgtatggagtgtataatacttttaccacagaggaaagatgggcattacacccgtgctctaagtctgatcccatgtatagcatgaaaagaagaaagaatattcatgcatgtacaatctgtggcaagatgtttccatcacagtcaaaacttgataggcatgtacttattcatactggtcagaggccttttaaatgtgtcttgtgtactaaatcttttcgaca

SEQ ID NO: 384040 - DNA, 280 bp, Homo sapiens
gcgctcagcccgttgccgcgccggccctgcggacgtgcgcgcgctgccttcgcggcacctgggcctgaggtgcgtgcctcccgggccctcgccagctccagatgcgtgaggaggacttcagaaacccgactgagaagtggagcgacccccagggagggtcggacctgcctcaataccgccaaggccttttatttatggctagtttgctctcgtgaaatactaacatcgttttaatggcactcatcaagtacgcaaatgatatgatttaacctcgcgcaat

SEQ ID NO: 384041 - DNA, 3078 bp, Homo sapiens
gcattcttttctgcaatgctgacacttccttctagttacaccctttggcactctaatctgtggtcttagttttagtcactgatgaagatatttggcacattaactcttatttcagttaacaccagatgaagtgaactcaattcctcttctcacacaaaagttggccccaaactagttcaaaaatatatttgaattctttcttggctagtgtcggttatttgtgtccctttagtgatctgattaatatttgcttttgtgatggttgtcacatcaagatagctgcaagcattgttaaagagacatttgataagagggactacttacctggaattcacccccagaccaccgaaatcttaactactgatgacagttttgtgtatcctttaaggagctcttgaactctgaattctatagagaaaataaaaagatttgttgaaaatgactgaccccatgtgggttgagaactatatccagttaactaaactgtaaacagctaactgaatctgttaacagttaagtatgttatctataaaataagcttcaagtagcactgtgttgtaacttcttggtgcctccaaattaagagttaaacccttagatctggctaaggaaatgactttatcctagcccaaaggagaccttttcctcaactcttcctccattatttttattctctattgtttactcatcgtctcatatgtcccctgtcatgttacattggaatcatttcttttagatgcaaactgcagctgatgtgttcattgggtctattgcagcccccaccaagtgttcacttctggtgagaggcatatccagggcctgagtgctggaacccaaagatgacaagggtggagcattgatgagttaacctcgcagctggagggtctgtgctgcatagtctccccttgggccatgagagcacatgcttgagaattacataagcctgtagcagggcagggctcagggctacggaattgataacaccagtgggactaaggcatccaccatctgttctttgttatgttcatgcccatcaccaaagtaaaaatcacagtcatccttctctccaccatttctgtctcaatcaatcacttcctcctaggctggccaaattatcttcttcaacttgccagaggaagagggaatgtcttttggtaaggcacagaggagcccttggttttccagttacactcctgctaattgcagagatttctcagttcgtggtaatcatggaggcttgcatctttaagcgcttgccatctgcaaaaactggccccagttgctatccggagatggcatctcccactgaaatctgcatgaactttgtccctgtgggctgcagggacctgagtagttttcaagtccctggcttttgataggaagcaaaaagcttctagattgagtacagcctgaaaaaggaagagaaatcgtgatacttcctgtgttgcaataacaaacacccgtcctaactgctgctagacagggaactggcagtttaacctcttcctgctcactagggaggtggggcagggcgagtgggagtggggagctcccctttcttgcaggctccatccacagaacacttcctacaaaccccttcctgcctttgtaatcctagtggtgcaaagctgccctgtctgctctgtgcagagccctctctgtgctctgcctcgcctgtgccctctctaattgccctcttccttacaaaatccagctgccggttgaggcttctctccctgaatttacagccatctaatcaactggtaatttactttcaatcagtgccggattgtgttcctcagattcatatctcctttttcatttagtgaggaaatgattgcctttcctctttaccatttgttttaaatattagctgccatgttgtgccgagcaatggtctcttaaatacgaaggtacgatctggcagttcaagacagcatttgtccaaagctgtctgaacacttacagtgtgctcgaggcaagtccgcatgcctaggactggggtagcgtctgtcatgctgtcttatgccccagtgacttaagttcttcagttgtcagtgtcaaatcttgatttctagaggctccttgttatttaattccagccaggaactgatttccttgcaggcttctgtgaggccatcctgaatggctgcagtggggtgaggatggtctggggctgtgctatgaggctttgaccctgaagtttcacctgttaagatctgaaaaactgcaggccaagaacattaacaggttgttttgtggcttgtggggcaggttgagtagcacagaagagaagctggggagatggagagagagcaggcaaggggagagtcagagatgaaatgagtgaccagtgggtcagctgaggctcatccgcccagaccctgctcttaggcatatcttgaatgtgtccctggacatgctcttacatgtgaatgatgttagtaagtctcatcctttctgctgagaagcactttcctagtaggacaggatcggggctgaggaactttcgaccccagcccactttctagctatttgctcttattaaaaatcttcctgctggccaggcacagtgactcaagcctgtaatcccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384042 - DNA, 794 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaggtgaagagctgataaaagacatttttttaacttcctta

SEQ ID NO: 384043 - DNA, 887 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaaaaaaaaaaaaaaaaaaaaaaaagaggggaaaaaaaaaaaataatgaaaaaaaaacaggatttgaaaaaaaatcctcgggggggggccggggcccgaattttcccaatagtggggctgttaaaaatcaatgggcgctcgtttaacaacgtgggggactggaaaaaccctggggttccccacttaatgcgttttgtggaaaatcccctt

SEQ ID NO: 384044 - DNA, 613 bp, Homo sapiens
gatgacatgtatttgcacaaaaattctcaggcacattaaattattgtaaactgaagtaaaacctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384045 - DNA, 765 bp, Homo sapiens
tgccaggcggaggcctcagagcatcctcagacgtgtgtttccacttgcacaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccaccgggaattagaaataccatctgccgtatgcagcaagggatctgcagactttttttctgccattctggaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384046 - DNA, 692 bp, Homo sapiens
gatgacatgtatttgcacaaaaattctcaggcacattaaattattgtaaactgaagtaaaacctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaaggggatgttccaccgggaattagaaataccatctgccgtatgcagcaagggatctgcagactttttttctgccattctggggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384047 - DNA, 717 bp, Homo sapiens
gatgacatgtatttgcacaaaaattctcaggcacattaaattattgtaaactgaagtaaaacctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384048 - DNA, 440 bp, Homo sapiens
gtgagcattcataaaacacaccctatcatcctcctggcaacatttcagatataaattatcgttcctgttttaaagctaagaggccaaagttcggttaaactggggcttgtccaaaagtacttagccttgtcagaatatataacccttggcagcgggctggggtcatcttctattctctgcactatatgagttaaatgtcaactctcttctgttgtatccataggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgtt

SEQ ID NO: 384049 - DNA, 494 bp, Homo sapiens
aagtctctcttaggcacaggcacctctgcagggctctctgtcatgcctctagaggggagagccattgttccatccctgaagggaatgacttcctgaagggcattggcccctattagccttggctcagagtgaaacgcagcaaacgtgcatgcctcagaactggcagacacgttctcagccaggagtgccaccaacccacaccagcagatctgtgtaccagaaacacaaaataacatgaagggccactggggggctggagcctggttccataaggatgggacttctgggcaggtgccgttagacagcagcaccttcttttggcctcatgttcctcagaaatgaaatgaaggaggtgggctcgatctcagactccatcagagcacagcagcctgggggtgtggaagcagagcctcacccaaggaccaaggggtctccaccaggtgagatggggaggatgggaaccccgtccctccctgccagggtgctgcaggtga

SEQ ID NO: 384050 - DNA, 963 bp, Homo sapiens
gtgggatagtagcgtgtccacattgtcctttgagaatgagaagtcatcctggagcacagctcttcccacgctccgggcccacacacccagcctcactccatcaaaggagccccgctgcctgcccacccaccctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaaaaaaaaaaaaaaaaaaaaaaaagaggggaaaaaaaaaaaataatgaaaaaaaaacaggatttgaaaaaaaatcctcgggggggggccggggcccgaattttcccaatagtggggctgttaaaaatcaatgggcgctcgtttaacaacgtgggggactggaaaaaccctggggttccccacttaatgcgttttgtggaaaatcccctt

SEQ ID NO: 384051 - DNA, 894 bp, Homo sapiens
gatgacatgtatttgcacaaaaattctcaggcacattaaattattgtaaactgaagtaaaacctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccaccgggaattagaaataccatctgccgtatgcagcaagggatctgcagactttttttctgccattctggtgagaaaaagcgtgacatttgctctgatccctggaataggtgttgcgtatcaaatacagatgaagaaggaaaagagaaaccagagatggatggcagatctgggatctaaaatataagctcccggaaggcagggatgttgaagtatcccaagggcttaaaggaatgtgtggcttatagtaggtgttcaataaatatttgttgaatgaatttagcaccaaaaaaaaaaaaaaaaaaaaaaaaaagaggggaaaaaaaaaaaataatgaaaaaaaaacaggatttgaaaaaaaatcctcgggggggggccggggcccgaattttcccaatagtggggctgttaaaaatcaatgggcgctcgtttaacaacgtgggggactggaaaaaccctggggttccccacttaatgcgttttgtggaaaatcccctt

SEQ ID NO: 384052 - DNA, 872 bp, Homo sapiens
gatgacatgtatttgcacaaaaattctcaggcacattaaattattgtaaactgaagtaaaacctgggtgctttctggcttgcagtgctcttggcagacatgaggcaacgattgctcccgtccgtcaccagccttctccttgtggccctgctgtttccaggatcgtctcaagccagacatgtgaaccactcagccactgaggctctcggagaactcagggaaagagcccctgggcaaggcacaaacgggtttcagctgctacgccacgcagtgaaacgggacctcttaccaccgcgcaccccaccttaccaagtgcacatctctcaccaggaggctcgaggaccctcatttaagatctgcgtgggctttttagggcctagatgggccaggggatgttccaccgggaattagaaataccatctgccgtatgcagcaagggatctgcagactttttttctgccattctggaaatgaaatgaaggaggtgggctcgatctcagactccatcagagcacagcagcctgggggtgtggaagcagagcctcacccaaggaccaaggggtctccaccagggacaggccagcagcacagacaacgctgtggataaggagagtagagacttcctcttcctgcctcctgtcttctggagttgtgaccgcagggtggcccaggtggatcggcttcagaggccaggaggcagctctctgcagccgaagagcaggagcctcacccagggtctgtggctctgactaagcctggactgcctctcggctgtgctccgtggactggctcctcagggatccatgtgagagaccggagtatgatcctcagtgcgaggacaaataaaagtagtgattatttccaccccaaact

SEQ ID NO: 384053 - DNA, 276 bp, Homo sapiens
aaattctcaaatattgctaatagtactgtggattttcctacattggtaaattgaaggaattgctaaatgctgaattcagcaaccagtttgagattgttgaaaataaagattgtttctttttcaatgcaagttcacagatcactggagttctagctacagtttgttctagaccagaggttgcagatatttttgtcctataaagagacacatggttaatatttttggctttgtgagttgtatagttttcgttgtagctgttcagctctgctacatgaa

SEQ ID NO: 384054 - DNA, 421 bp, Homo sapiens
gctgtgaagaatatgaagaggttagtattctcccccagtttggcagaggctggccatctgtgaactgcccatgctttctagaatgtcggagttttggagtgtgatgatgcgtctgtatatcatatctttctagtcttccattgcgctttcatttgttagtctcctcttgttttgccatttttctactccctcacatgtgcttttgcccttcttaaaaatattcttcgtctgtaatccgagcattttgggaggccgagagaccagcctgaccaatatggtgaaaatccgtctctattaaaaatacaaaaatgagccgggcgtggtggcagcgcctgtagtcccacctactcggtaggctgagacaggagaattgcttgaaccctggaggcagaggttgtggtgagcagagattgcgccactg

SEQ ID NO: 384055 - DNA, 410 bp, Homo sapiens
tcctctccttatcataacactatttaaaggaagaaattgtaggatgaaacggggttactcatgggagtactttgacgtgccaaaagtaaaacactgaaaaagaaaaaaggtcacttttctagcttcaaaaaccacaagggatgaatcaaatgctttgagacgtaatatgtgatgctcttctagaactgaagctgtgtgttctttcaatcccagtcaatgtggttgcttgtgtataccttaggtagataataaaattcattgttaaaaaaatgtacagctactgatttagggtggtttctaaaggtcactgtaaatgaatatgtttggaacagttgataaggcagaatgcaggacggagattttttctctcatttaacaagttagcaatttcttcaatccgttaaattacc

SEQ ID NO: 384056 - DNA, 1048 bp, Homo sapiens
gcactttgggaggccgaggtaggtggatcacctgaggtcaggggttcaagaccagccttgccaacatggtgaaccctgtctctactaaaaatacaaaaattagccgggcatggtggtgcatgcctgtattcccagctactctggaggctaaggcaggagaatcacttgaacccgggaggtggaggctgcagtgaatcaagattgcaccactgcacactagcctaggcaaaagagcaagactctgtctcaagaaaaaaaaaaaaaaagaatttataggaagatgaataattttttaaaattaaattataaaggaaccgcctttattgaaatcattatctttatctgaattccataacttaaaaatagcttttcccccattccctccctctcaacagtatgaaaataagaaaaaatgtattgcagttttaaaagaaagaagaaaatatgtatgactttagattggagtctcaggaaagttctgaaaagagggtggacaaaaggcttcagtatccttagggcacagtaaatctatttattcctccaccaacttgaagcctaaagccaaaactgtcatgctgtcacatagacaaacttctcaagacgtaaagctgaacttctcctaccttaaaatgaatgcaaactaccgaggaaatagcaaaatacccgaggaaataacaaactggaagagtattttggctttttcagtacctcctaaccacagcgttttagagctgaatttgaagataagctgagtaatttaaacaggataaaagtgtcattttcagattggatagagcaggaaaatatatggcttttgttttccttctggttgttactttttaccgaatctgggcaatctatctaaagaggggtcatagttctgacctctggctttgtgagcatattattgcacgcacggtatcaattggtcaccttcttttcctagccagcccttgaagctgtgttggtggcctgtgaccttccaatgcaatctagactgtggaactcactgtgtactgcgatccatgggcaaatggtgtgtgcagga

SEQ ID NO: 384057 - DNA, 690 bp, Homo sapiens
  misc_feature (282)..(282): n is a, c, g, or t
taagaatctgattcagctgatggagtgtggcttgtttttcaattttggtaattgggtctggaggaataattttatccctaatgcaggttggcagccgtgggtaagatccagtagttagtacatcaatggcatatgggatggcacaactaggcaggcgtgcatggaccagagcatctctagctaacgaggccaggcgatcagcagtgtccacaaacaggatggcttgctgatctaaaaagcttgaaatcatcgcacatttttccactttgccagcattattancccatttcactaaagctaataatcgaacgaagagttggcgtgtccggctagcaaactgcactatttctattttcctttccacatcagatttccttggcagtatgttgactgcccgaggcggaagtcgatcggcagagcggaagggggacctgcagaggaccttccgacaggtctgtgtctgttctctcagctgtctagcaccgcagcgctggggggcgcgtgggagtgaggcggtacctgtgagcgcgcgggagagcggaaaagggagccgcgcgccgccggaaaccagggtgagggctgagccggagtcgtcaccgggaacgtcagcagttgccccgcccttaccctcgccgctctccctcccgcctccgccccctggcgttgtaaaggcgacaatttgcccagaga

SEQ ID NO: 384058 - DNA, 910 bp, Homo sapiens
agcgggcactggggccatggcggcgcaggaccgggcttggcgcaacggcacacgatgcggtcctcgagcctcccgggcgctcggtcaccgcgccgaaacgggagcgggcagagtcgccaccgcctaccgccgggccgcctcagaacaggaagccgtgcgccgaccgcggaagcccgcccccatgtagcgagaagtccgccgaccccagggacaggagcaaggggcgggggaagacggggatgggggggaagcagggcggccccgcagaggggaagctgcgcctccgcaaacgctcagaagcagcttcgccagacagccgcaacgtacatgttgactgcccgaggcggaagtcgatcggcagagcggaagggggacctgcagaggaccttccgacaggttggtcagaccatgcccatggttcctcctctcgacttcactatgaatgccgcatctgttgaatgaatgcagtttctgctcttgcttttggatagaagtgattgcaaatcttatcaaaataatgaaaaaaattacttttcaattccttttcaacccttttgagtctgaggggcagctgtacattaaatgaaaccatatgtatcataatttcatttttccatcaaaagagctttaaaggaaattcccctttttctccatgttttcaatattttttgttccttttgttaaaatcagattaatctcatgaaacatctgaagcatttaagtcaatttaagagctgagaaaatatcatgctgctagttctgaaacgatctgaagtgtgaatcaggtgatcaccaaataggggaacaactgaaaaatgtgaatgaaagaagtatgtacctatactatagtgtcaaatattgtactgtaagctttaaaatgataaattggaaactttccaaaaaaaaaaaa

SEQ ID NO: 384059 - DNA, 543 bp, Homo sapiens
catacacagcagacgtgtgcctgtggagtggaattctggaaaagctcacagcccagaacataatgcagactcccccagccacagcaccttccaatcctgagaagagtgctgattctccatctgagcacccattctcctgcaacatcaggggagaggatttcacctaagggtcagaccagcgtctccaaacccagctccccacctttgcctgttggtggcacttgtgggagaaggggagatgatatgaaaagagccacaacaggagtcacctggacagggtggagcttgatggaaactgacatttgtgcccattggaggcaaatgtagaatttggtatcttccgtagcgtcaggcacatgaaactctccagtgcccatgacttttgacagtgacttcagagcacatctgggagacccatgtggcccaggctccacacagaggatacagaggaccaactgtataccacttcatgtgatgttggagtgctgttctgcacgcctaactttatggcttggtggatcagacaatgcccaatgtatgatg

SEQ ID NO: 384060 - DNA, 415 bp, Homo sapiens
cctcattccacacctcctcctgtgtgctccttactctactgagaatgaagccctccacaccacccgccatgcttctcagggaaacattagtagcctactttcagaagtcacctccactatcaatattccatgaaagcttaaccaaagcatttgggcagatttagtgctaggaaatataatttttatgtgcataaagaatatttaacacttaaaaaatttttattgtggtaaaaacacttaatgtaacatccaccctcttaataaatgcttaaatgagtaatacattgttgtttactattgatcaacactgttaacataaacaacaacaaattacaacaatgtgttgtcttttgcctattaaacggtcatggcagatgtcccatgctggtagggatttgataggatgaccactctc

SEQ ID NO: 384061 - DNA, 354 bp, Homo sapiens
ttcctgctgtctatagcatgtacccatttgtacctgttcatttgtggggggcgtggtgctcctggctgaactgaagccagtacaggccacagaagaagtcatgacctctgtctggggaaggaagagtgtgtagaggaagttttgggtgccaatgcccagggccagagagggagaaatctgtggagtgccttgtcctgacgtagacacatgggccaggtctgggctctactgagaaaggcattgatatgatgagcacatattattcttataattaaaacaacaacaacaacaaaaaaccaagttatccatggatagtccataagcaagcatggttgattctccctacagaatatc

SEQ ID NO: 384062 - DNA, 516 bp, Homo sapiens
atctgaagagaatcatagactttgttaataagattttcactgattcatgccacttcctcaaagaagtcttactttccctaccaaagactactggaatacctgttctacattttcataacaccctgcatacctccttcatataacttatcacaattttaattatacaaaaattatgtacttaattgtttaatgtttgtacctgctactaggctgtaagttccaggaggtgagagattaagtctgtcttgtttgccctgtctccaaaacatctagcacaggattttttacataacaatacttcataaatatttgttgagtaaatgattaaaattctttttgaaaactactgaaatttgtaggtcagtaaaatctagagaattatgcctcagaaattgccattaaattttttattgagaaatgaagcaagctcctctatgccatataaaaagaaaaaatgtaactacgtggcaatccttttcttatattagaaaaagaattacttctttctggaaggta

SEQ ID NO: 384063 - DNA, 391 bp, Homo sapiens
cccatcaccacttctattcaatactgtactggaggtcagctaaataaatcagttaaaactaacaagcataagagctgcaaggaaaaaacggtcactatttattcacaattacatgactgggtacagagacaatccaacataagctacagagaatatcagaattaataactgattaggcaaggggtacaaggccaatatgcaaaaatcattgtatttctatataccaacaacaaacagagaaaatgacatttaaagtagatacggctgggcacggtggctcatgcctgaaatcccagcactttgggaggccgaggcaggtggatcacaaaagtcaagagttcaagaccagcctggccaatatggtgaaatcccatgtctactaaaaatacaa

SEQ ID NO: 384064 - DNA, 365 bp, Homo sapiens
actcctcccaactaacaatgacccaaacaggcaggaaaatccctgcagctggccatagtggtgccaccgggtgggaagaaggcaggagaggaagcgcagaaggatcattaatcatgagagatgatcatcttaagagaagtgaggaggtgggagactcatattatttttatttatttattttttgagatggagtctcgctctgttgctcaggctggagtgcggtggcacgatcttggctcactgcaaactctgcctcctgggttcactccattctcctgcctcagcctcccgagtaactgggactacaggtgcctgccaccacacccggctaattttttgtatttttagtagagacagggtttcac

SEQ ID NO: 384065 - DNA, 408 bp, Homo sapiens
aatcgcttgaatccgggaagcagaggttgcagtgagccaagatcatgctactgcactccagcctgggtgacagagcgagactccgtctcaaaaaaaaaaaaaaagaaggggcagggcagaaaggtgcagaccacatccccagggaaacccacccctgagacccagggctgggggtgtgtcaagtaattgagggtgggcctgggggtgtaggcagtagggatgagggccacacttcagtgctgtaggtcacgccctcagggaggcaatctctggagaccccaagcctgtaatgaggacatgtgggagatgaacattgagaatgggctcctgtgggctgggtgcagtggcttatgcttataatcctagcaatttgtgaggccgaggtgggcagatcacctgaggtcagga

SEQ ID NO: 384066 - DNA, 576 bp, Homo sapiens
ctggcccagcagtcctgcttctgtgtgaactcagccaacaaatgcagccttctgttgtcccaggaagcacagacaccagagaaggcattcccaccaacaccagccactggtagccaggcaagccacacctgccagagctggcccagtggctctacttctacctgaatttgtcaagggacgcagcctcctgttgcactggaaacacccagacagcagggcagccaactgcatccacccacccccgcgtcctgtagccagatgggccacacccagtagtttccaatccagtggtcctgattctgcctgaactctgcaggcagggacaacctcgtgtttccccaggaagcacacagacagcagattggagctgacctggcaaggttacagcttgtctgccacctgtggcccttgcctaagggagctccatggaccagaacaccccaaaaaagaaatgcaaatagggagacagtaattggaaggggctcctccaagacctaggagtggactagaattgaaagcagttaaccaaacccaccttggtttggtttgccctgtagtcaaacccccaagggcatc

SEQ ID NO: 384067 - DNA, 788 bp, Homo sapiens
taggtttcacctattttaatttagtgaaatatttgggaagcctgattcattcgtagaatgatgggggacacattttctaaagcagggtagttttgttcaataaaaaataaatgtcagtgaggataaagaacctgcagttaagcgttaagctttgtggccagtcttgggattaaaatgagcactaaatccgagaaacaaacccatgtgacatcatctagggcagacctgcttttgacttcagtgagtgagctccaggagtgaattctcaggaggcacacacccagagagtctgcacaaatacattacacacccagggttcagcacttctcactggtccagtaagttgagatttgggtttgggatattttatatccacctagaaatatacatttggaaattaacccttttattaagagtcaagcttttataacaaatgtttaataagactcatatttgaatttttgagtttttcaaagcctgcttcttgaagctcttggtaataaggacctaaaatatctgaaataaaacttccctttccactttcctcctcttcttcttctttctttcacatcctgttttttttctcctctcttcctttcttctttttcttcctgtttctgcagacccttgcccttgtgtttaattctctcatcatgtatgtagtccctgctgtttgctcattgcataatcagcgctagaggaaagccaagaggtaaagtctcatcattccttaatgatgcaggtagcatccctgagctcctgtctgctttgtcactcatgttggaaag

SEQ ID NO: 384068 - DNA, 411 bp, Homo sapiens
ttgtttaccttgaagtgacaggctcacttcatacagtttcaagagactgtctgcccagatgcctaagtctaaaaccatagtttgtctatcattctttcaagtaaaaatggtggtcggtgaaaaaagaagctgctaaatcaatatgcaacttgaataatcgcccaaatgcttttccttgtgacaaccaccgtactctaccagtgtgcagcagaggcggtttatgcatatttcccatttcttcaaacaagtttaaaaagatgtactcaggatcaggcatggtggcccacacctcccagcactctgggaggccaagacgggtagatcactttaggtcaggagttccagaccagcctggccaacatggcgaaaccccgtctctactaaaaatacaaaaattagctgggtgtggtg

SEQ ID NO: 384069 - DNA, 308 bp, Homo sapiens
gaaagcatttgaactaagtctgtaaaaatggcagataataattaacacttggtagcaagaaacgctttctgaaatactgaaacactgcttgtttcactgtaacttatcacctagtgctgtatctgcatagtctcacaattcaactttatatccaacatgggtgttcatttctatttggataaaatttactgaaatatactagaaagaaaactggtcttaaaatgcaaaaggctctgccactaattcactgatcttaacttagtttactaattaacttcttattatagttttccaaatccgcatgcacg

SEQ ID NO: 384070 - DNA, 717 bp, Homo sapiens
cctcccagaggtatatctgttttagtttgtaatcaggaatgatcaaggaaaattatgtggcctctaaagcaggctgataatgttttgcataaatcggaaaggccaaggggtggaaatgactaggaagcagatttcagcttactgtaaaagagtatctacccttgaaatttgatgccctgtactaaatgtaggaggctgaaaaacaacatactactaagcatcaagttgctgagactctgcactggtcttctgaatacaaatattattattgactagtggttaattgtggtaatgataagtgttcataatcttattttgagatgtgatatccattccatatatgaagggagagccaaacaaacaaaccaaaaaaaggaaacaaacaaaaaaggaaataaaattcctcgtgtgacagtttatgctgagataaaggcagtggtaacatcaaaggatggtttgaaggagctttgaatagtccccataatatcatcagtccatcagagccactctaaataaacaggataaattttaaatgtgctcaatgtggttccaagctaagggcattggcccaatggtgtctgtattagttcgttttcatgctgctgataaagacatactcgagactgggaagaaaaagaggtttaattggacttacagttccacatagctggggaggcctcagaatcatggtgggaggcaaaaggcacttcttacatg

SEQ ID NO: 384071 - DNA, 1184 bp, Homo sapiens
cgcacttttccacctcagaagtgcctcagcagaaaggcgatgaacctcgggggtgcatcatctttctgttagaatgggagcatgagttttctgatcattttcccttcacagattcctccgccagaaatcttactcgcggcgccttcatttccgggtccgccattttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggagaaaaacaatgctgagattttggtcatcctccaggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaatt

SEQ ID NO: 384072 - DNA, 1130 bp, Homo sapiens
cgcacttttccacctcagaagtgcctcagcagaaaggcgatgaacctcgggggtgcatcatctttctgttagaatgggagcatgagttttctgatcattttcccttcacagattcctccgccagaaatcttactcgcggcgccttcatttccgggtccgccattttgttgcctctgtttctccacgagggggggttaaaggcccccaaaacatgcacacatgaaaagggcaaaaagtaaccgtccttgacagggagtcttaactagagaaggaaacgggactaaactggcgggctccgtggaagcgtggccggcagcgtcccggacgaggagatgtctttggtggacttgggaaagaggttgctagaagcagcaagaaaaggccaagatgatgaagtgagaacgttgatggcaaatggcgccccattcaccacagactggcttggaacatcacccctccaccttgcagctcaatatggtcattattccacagcagaagtactccttcgagcaggtgttagcagggatgcccggactaaagtagacaggacccccttgcacatggctgcagccgatggacatgcgcacatcgtggaactgcttgttcggaatggtgcagatgtgaatgccaaggacatgctgaagatgacagctttgcattgggccacagagcgccaccatcgagatgtcgtagagttacttatcaaatatggagctgatgtccatgctttcagcaaatttgataaatcagcctttgacatagctctggtgaatgttaatccagagagagccaaccctgtgactgaccctgtgagtatggctgctccattcatcttcacgtcgggtgaggttgttaacctcgcaagccttatttcttcaaccaacaccaaaacaacctcagccaatacagaggaaattatagaaggaaattccgttgactcatcaatccagcaagtaatggggagtggaggccagagggtcatcaccatagtgactgatggagtccctctgggtaatatccaaacttcaatccctactggaggcattggccagccatttattgtaactgtgcaagatggacagcaagttctaactgtacctgctggtaaggttgcagaggagactgtaatt

SEQ ID NO: 384073 - DNA, 667 bp, Homo sapiens
agatgtctgagtgggcaggaggtagttctagtttagattgtgttatcagggcaggtttctcaaggacgtagggttggagccttccaggtagatggcacagtcaaagaaaaggccctggggatgagaaccagcttgggaaaaaaagtaaccaaaactgagaaagatactatgtgagttcagagagggagatcaagaccagatcacttgcctaacacttttaaattctaattgtccatatagttaattaaaaataataatctgattttaacgctctaaagcttaaaaacatctagttcaaactgaacttcacccagttggtctgttttgttacaatattttttatcaaatataaaattgtacttaaaagagaaagttataaatgaataattccacccaggtgttcccaagtccaccagtcttttaaaatcactctttcccttcaagtataaatagaacacacactctttcataaaaagttacccaactcccatctgtaacagaaaaacctcaaatccttcctgagaatcattagcacttttcttcaagtaaatttgccctaatttactgcttttgctaaattttagtctcacttatatctatcctctgactcctttatttcctaatgaagagcctatttccttaattttctttagttgcactcccagcc

SEQ ID NO: 384074 - DNA, 429 bp, Homo sapiens
gttaaaaaattacaatgcatcttagagaatattggataaatatcaaattataaggtagagtttttcaaaacttgtgggctcaactaaagtagggcttagaggaaaatttacagctttaagtgagaaattagaaaaaaaggtaataggctgggcatgctgactcatgcctgtaatcccaccactttgtgaggccaaggtagaggataacttgaggtcaggagtttgagacccacctgggtaacattacacaggaccctgtctctacaaaacaatgttttgtaaaattagccagccatggagggacacacttgtagtcctacctccttgggaggctgaggcagtaggattacttgagcctaggattttgaggttgcagtgagctgtgttcatgccactgcactccagctgggtgacaaagtgtgacactaa

SEQ ID NO: 384075 - DNA, 190 bp, Homo sapiens
agtttgaagtgctgccatctcaacttgtctgagaagcactgtttgtccttgcacaaaaggggtgtaagtatgtacaggggaaggggacacacattctttgccttgcccaaggtccacactcctggaaaggcattctttccaaatataggcaacagaaggtgcacctggcctcttctttccattctgaatg

SEQ ID NO: 384076 - DNA, 2270 bp, Homo sapiens
  misc_feature (221)..(221): n is a, c, g, or t
  misc_feature (1230)..(1230): n is a, c, g, or t
  misc_feature (1632)..(1632): n is a, c, g, or t
ggccaagaattgtgtgtctgccaccagcgccccctggcctaggtggcccctgggtgtccttaatctcctgtgtgtgttagaggggcaggcattgcacccaccgaactccctagacctgttcgctggtccttactcttcctggctgtcagatccaactaccaggctctgtggccacagtctcctgctgggctgcccctggtgccccagccagagacccccangtgcgtcccttcatcgcccttccctcccttcttcgctgatggctgtctgggtgactgtgttcgtcttctcttccccaggtgaccaggcattgatgcacccccaggaaggccacgcgctcaggaggccccccccccgctggctgctgctcacatggtgtctgggcccttggcactccggtggtgcgcgtgggcagggcgcggggacatggggcccgacatggagctgcccagccactcgaagcagctcctgctgcagctgaaccagcagaggaccaagggcttcctgtgtgacgtcatcatcatggtggagaactccatcttccgggcccacaagaacgtcctagccgccagcagcatctatttcaagtccctggtcctgcacgacaacctcatcaacctggacacagacatggtcagctccacagtgttccagcagatcttggacttcatctacacaggcaagctgctgcccagcgaccagccagccgagcccaacttcagcaccctcctcactgccgccagctacctccagctgcccgagttggcagccctctgccgccgcaaactcaagcgagccggcaagccctttggctctgggagggcggggtccactggcatggggcggcccccccgcagccagcggctgtccacggcctctgtcatccaagctcggtatcaggggctcgtggatgggcgcaagggggcccacgccccccaggagctcccccaagccaaaggctcagacgatgaactctttcttggtggctctaaccaggatagcgtgcaaggtctgggccgggctgtctgcccagctggcggggaggcgggtctggggggctgcagcagcagcaccaacgggagcagcgggggctgcgagcaggagctgggcttggacctgtccaagaaaagcccacccttgccccctgccaccccaggtccccacctcactcccgatgacgcagcccagctgagcgacagccaacatggctcgccccctgcggcctctgcncctcccgttgccaacagtgcctcttattctgagctggggggcacccctgatgagcccatggatctggagggggccgaggacaaccacctgagcctgctggaggcgcctggtgggcagcctcggaagagcctccggcactccactcggaagaaggagtggggcaagaaggagcctgtggctggctccccctttgagcggagagaagcagggcccaagggtccctgcccgggagaggagggtgagggggtcggggacagggttcccaatggcatcctggctagtggggctggccctagcgggccctatggggagcccccctacccctgcaaggaggaggaggagaacggcaaggatgcaagtgaagacagtgcgcagagcgggagcgaggggggcagcggccangccagcgcccactacatgtaccggcaggagggctacgagacggtgtcctacggggacaacttgtatgtgtgcattccctgcgccaagggcttccccagctctgagcagctcaatgcgcacgtggagactcacacggaggaagagctgttcatcaaggaagagggggcctacgagacaggcagtgggggtgccgaggaggaggccgaggacctgtcagcacccagtgcggcctacacggctgagccccggcccttcaagtgttcggtctgcgagaagacctacaaggacccagccacgctgcggcagcacgagaagacgcactggctgacacggcccttcccctgcaacatctgtggcaaaatgttcacgcagcgcggcaccatgacgcgtcacatgcggagccacctgggcctgaagcccttcgcctgcgatgagtgtggcatgcgcttcacccgtcagtaccgcctcacggagcacatgcgtgtgcactcgggcgagaaaccttacgagtgccagctgtgcgggggcaagttcacccagcagcgcaacctcatcagccacctgcgcatgcacacctccccctcctagaagccaaagacccgcgggcgccctctgccaccttgctccccgggaaccca

SEQ ID NO: 384077 - DNA, 247 bp, Homo sapiens
caaagaagaatcaccatgtgacatgagtcaggtcctcctaggagttgccatcagggagggaattatatgatatccctgaaaaccaggtctaagcaaagcatacaacactataattgtcctcttatttttctataaaatgaggattttcacatgttccttatgagttgctgtagccaaagccttcttccttgtgatctgggaaaaaagggttcctcctgtttgtcttagatcaccctgcaggtacatg

SEQ ID NO: 384078 - DNA, 253 bp, Homo sapiens
tttaaagtgaaccagtaacagtatagttgagcagtaacctttggatttcactgttttaataatctatgctttaaactgcatcagtttatatattatatattatatatatagttaataatattctttattaacaatattgccaaaatttttttaaacaagagtttaccaggaagaaaataagttaggttttaataatttattttgcatgtttaatatcattatttaaaaaatatatttcttaggaaattagctc

SEQ ID NO: 384079 - DNA, 793 bp, Homo sapiens
tgctgagattatgagccactgtgcccggcccccagttccaaaacctataatcaattgtatacttagcagttcaatatccctaatctgaaaacccaaaatgctcctgtgagcgtatcctttgagtgctatgtcggcactccaaaagtttcaggttttggaccattttggatctcggtactcaaaaagctttggattttggagcattttgaatttcaaatttttggattagggatgctcaacctgtacaaaatagtagtagtcaagacaatgtgatactggcatagaatagacataaggtcagtgcagtagaattgagaattgtcttagtctgcttgggctgctgtaacaaaatactgtaaactgtgtggcttgtaaacatcaaatttattttccacatttctggaagctggaaagtccaagatcaaggcactagcagatttcgtgtctgagaagggcatgttcttactgtggaaggggcgactgagctcactctttcctcttttacaaggacactaatcccactcatgagggctctgccctcatgacctaataatttcccaaagatcccacctcctaaagccggaggttaggatttcagcacgtgaatttgtgtatgtgtggtgtatgtatgtgtatgtgtatgtattggggtggaggaggctcacaaaacattcagactgtaacaagaatagcagggcatggtggttcatgcctgtaatcccagcactttgggaggccaaggcaagcagatcgtttgagcccaggagcttgagaccagtgtgggaaacatccc

SEQ ID NO: 384080 - DNA, 1217 bp, Homo sapiens
ccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacactttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttcaaaaaaaaa

SEQ ID NO: 384081 - DNA, 801 bp, Homo sapiens
aggcatcgggatgggctgggacagggcatgttctgggcagggagtgaagagctaaccagagagaaatgtagtcacagcccagtccacctccacccacaagggctgaggagcctaggcacaggctggcaggagaagctggggctgccgcttcattggtaggtttgcatgtcctggggcagtgagggcacttgcccatctttcttgttcctttttctccttgaaggggccagagctagtactgacccccttgcactgtccctaatcttccacagacccacgacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaa

SEQ ID NO: 384082 - DNA, 1085 bp, Homo sapiens
ttacgggctagtggggccggtgtgaatcggacgaggcccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaacccctggtaccagtgtgtccatctccaggctccttgccttccccttacctgaccttattaataaagtctttcttagcagttcaaaaaaaaa

SEQ ID NO: 384083 - DNA, 1126 bp, Homo sapiens
ccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacactttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaa

SEQ ID NO: 384084 - DNA, 1028 bp, Homo sapiens
ccgggaggctgcccggctagaaatcaacgtgctcaaaaaaatcaaggagaaggacaaagaaaacaagttcctgtgtgtcttgatgtctgactggttcaacttccacggtcacatgtgcatcgcctttgagctcctgggcaagaacactttgagttcctgaaggagaataacttccagccttaccccctaccacatgtccggcacatggcctaccagctctgccacgcccttagatttctgcatgagaatcagctgacccatacagacttgaaaccagagaacatcctgtttgtgaattctgagtttgaaaccctctacaatgagcacaagagctgtgaggagaagtcagtgaagaacaccagcatccgagtggctgactttggcagtgccacatttgaccatgagcaccacaccaccattgtggccacccgtcactatcgcccgcctgaggtgatccttgagctgggctgggcacagccctgtgacgtctggagcattggctgcattctctttgagtactaccggggcttcacactcttccagacccacgaaaaccgagagcacctggtgatgatggagaagatcctagggcccatcccatcacacatgatccaccgtaccaggaagcagaaatatttctacaaagggggcctagtttgggatgagaacagctctgacggccggtatgtgaaggagaactgcaaacctctgaagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaagccacgcaaccctacaagccacggtcacccacaagccacggacgggtaagga

SEQ ID NO: 384085 - DNA, 994 bp, Homo sapiens
ttacgggctagtggggccggtgtgaatcggacgaggcccaagactgctgggtgctggcaatggggcttcttgcaaactgccccagaggggcccttagccctaccccttccccatagggtggctatgaatgtaattggggaacaccagaagagccagatgtcagaagccctgctgcttcctgtccctctctctcctcgaaattttgggaagaactaggcaggactgaggtgagggggagggaagacctagacatggccaggaagcctctgtcaactgcatttggtgctcggacaagtgaatttcgcagaggtgatctctacccacctgtcaggactttgcatgtgggggcagaggcatcaacccagcaagacacctagtagcctggcaagttccgagcaaaacgttaaacaggcatgaaaggaaaggagctgctcattgtccaggagggcggaagtagagtcctccaaggaggcatcactgcctcctcgatccagtccagcaaggcgtcccagaggcaaggggacctgctgtggcttcccacgaccctgccgtcacactgaggcaccttgtgtccctgagcagagttacatgctccaagactccctggagcacgtgcagctgtttgacctgatgaggaggatgttagaatttgaccctgcccagcgcatcacactggccgaggccctgctgcaccccttctttgctggcctgacccctgaggagcggtccttccacaccagccgcaacccaagcagatgacaggcacaggccaccgcatgaggagatggagggcgggactgggccgcccagccccttgactccagcctcgaccgccaggccccaggccagagccacccaatgaacagtgcaatgtgaaggaaggcaggagcctgcaggggagcagacttggtgcccagctgccagaaagcacagatttgacccaagctatttatatgttataaagttataataaagtgtttcttactgtttgtaa

SEQ ID NO: 384086 - DNA, 1107 bp, Homo sapiens
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaa

SEQ ID NO: 384087 - DNA, 1156 bp, Homo sapiens
acccgcggagtgcggagggaggctgggctctgggaagtccgcgcgcggctccgcttcagaggcagggcaagtgggcgcggtcctggggcggcggcgggggccgggagaggagggctgggggtctcgagaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaa

SEQ ID NO: 384088 - DNA, 1122 bp, Homo sapiens
acccgcggagtgcggagggaggctgggctctgggaagtccgcgcgcggctccgcttcagaggcaggctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaag

SEQ ID NO: 384089 - DNA, 846 bp, Homo sapiens
ggcgtggagcgtccccagggagaaccggagcgggaggatggcccgcgaatgtccccgagggggatcctgtgctgcttaggaccacgccgtcccctctccacggccccgaggggtgccagcaacccctttcagcagcagggttaggaactggggcccttgcaaggccacaggtcaggcggttctggccagaagtccgcagtcctagttcttccctgtcctgtcccacaggccactggttgtcagtagaggtttttgcccctcagtataaactgtgtccagatctgtaggctgcccatccagccctccaggcagcctcttcccatcgagttgtgcccccgaagaaggacagaggtccagcatggggtcagtgggctgaatccatcccccgaacatgccacagcccaggggaggccagcctgcctggcagctgacacccagccctccccccagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacct

SEQ ID NO: 384090 - DNA, 1091 bp, Homo sapiens
acccgcggagtgcggagggaggctgggctctgggaagtccgcgcgcggctccgcttcagaggcaggctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaa

SEQ ID NO: 384091 - DNA, 1295 bp, Homo sapiens
acccgcggagtgcggagggaggctgggctctgggaagtccgcgcgcggctccgcttcagaggcaggctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaaaaaaacaaaacatagtatataatgaatcccaatagaaatgaaaacaaacaaaaaaaggagaagaaacagacacggaggacacatatagagggaaaccgtactgtagtggacaaaccgtgtcatgcagtatgatgcgactactcactgactgtcactagggcgggtgttactcttattacgggttgttcatattcagactgcgat

SEQ ID NO: 384092 - DNA, 738 bp, Homo sapiens
ggaagaggccccagcactgacctccgtgggggtggagatgaggaggatggaaagggtgtcttcctccagcatcttcctgaagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaag

SEQ ID NO: 384093 - DNA, 506 bp, Homo sapiens
gctcggtaccccaacgatggtcctcagctagaagagttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384094 - DNA, 313 bp, Homo sapiens
aattaacattgagccataaaaatccccaaatatggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384095 - DNA, 341 bp, Homo sapiens
ggataacttgaggccaggagttcaagaccagcctggcaacatggtgaaaccccgtctctactaaaaatacaaaaattagcctggcgtggtggcacacgcctgtaatcctagctacttgggaggctgagtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384096 - DNA, 367 bp, Homo sapiens
tccttgtaatccaagcagtcgcaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagaccaacaaatgcgccagccagtcggcactatgctttgttaacaggaggggatcctaa

SEQ ID NO: 384097 - DNA, 2166 bp, Homo sapiens
tcaggctggttacgcccccggagtaacgggatgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384098 - DNA, 2171 bp, Homo sapiens
  misc_feature (28)..(28): n is a, c, g, or t
caatgccaggctggtacggtcctgaggngtttggactgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384099 - DNA, 2586 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttccccagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384100 - DNA, 2530 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384101 - DNA, 2570 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgtcttccacagcggacccgtcttccgcagccttctgtcttcc

SEQ ID NO: 384102 - DNA, 2329 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttcctgggcgacagaatgaaactcctca

SEQ ID NO: 384103 - DNA, 2895 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggatctcactctgttgcccaggctggagtgcagtggcacgatctcggctcactgcaacctctgcctcccgggttcaagagattctccttcctgcctcagcctcccgagtagctgggactacaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384104 - DNA, 2746 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384105 - DNA, 2656 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384106 - DNA, 1682 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggagaatcgctttaacctggaaggcggaggttgtggtgagctgagatcacaccattgcactccagcctgggcaataatagtaaaactccatctc

SEQ ID NO: 384107 - DNA, 848 bp, Homo sapiens
gatcgtatgtttgacccaggctgagcctaatcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384108 - DNA, 783 bp, Homo sapiens
gcaaacctgccgggcgaccctagaggaacccctatccgcggtcggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384109 - DNA, 359 bp, Homo sapiens
ccggccccgcccacgtagatttgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384110 - DNA, 2773 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384111 - DNA, 2159 bp, Homo sapiens
gctggtacggccgagatttaggatcggcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384112 - DNA, 3003 bp, Homo sapiens
  misc_feature (3003)..(3003): n is a, c, g, or t
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaagaaagaaaaaaaaaaaagaaaaaccaaaacagacaaaaaaaaaaaaaaaagaacaagaagaagggagaaaaaaagccccgaggagagcaaacaaagagcggacaacaccggcggcgtcgacaagagagaggacacagaacccacagctcgcgagcacacaggtggacacacacggcgggcacacagtagggggggacaatcaagcgggacaccacgagggacagcgatcggn

SEQ ID NO: 384113 - DNA, 2696 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgtgcccagccgacatggttttatcttgatcaaaccactgaagacttcaaagagggtcaaacagttgggcagtattaccagatacaatattatcagctacattaaggtgtctcaaaattgtttttcttgtagac

SEQ ID NO: 384114 - DNA, 2689 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgatttttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384115 - DNA, 2037 bp, Homo sapiens
aaccgcaggttccgtgccctcatgaaacgcgacggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384116 - DNA, 1680 bp, Homo sapiens
cctcttgggctcaacggatcctcccccttcggcctcagcctcccaagtagctagaactccaggtgcaagctaccgcacccagtaagaatcctattctcttttggactgacaaactcctactcatccaacaaagccccagctccaatggccccttctctgaggaacctgccctggttccctggtccacctcccagctagtagagttccctgggaaggggttagacgcctctaagtggcagagaggggccctcattcctgccccaaaggtagccttctcccctcccctttctggcagaagagaagtctgagatggagaaagagtgagagccgcccaggagctctgagcagagagcccgcaggagtgccacgtcccggcggcctcggcccctccctgcctcagtttcccgtggcatcaaagggggcgaggggcccctccaggcctctggtgacgggggtgctgtgcccaggcgggggtccgggggcgaccgaggggtctcaggaagtccgcggccgcaggaattcggcgcctccaggccttataaggacatttgcgctccgggccaatcagcggcgggggcgtggcgcgcggagcccggcgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggttttttatacgctttgcagggtaccgactc

SEQ ID NO: 384117 - DNA, 1804 bp, Homo sapiens
acggggctgaggccgtgtcagcacgaatggaccccaaacagaccaccctcctgtgtctgtggtgctctgtctgggccagaggattcaggcacaggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgcgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctccccatctgggtttttgggtttttctgtgttttcatctttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctggttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagatcaacagacttcagaccctcagacctgccccggggccaggtggagaaagtgagggccgtacaaggaagtgaaattctgagttgttggggctaagcctgaccccctctccatgctccccgccccaactcactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccaggccctcagtaggttttaaggagtccccagccctcctcccttctgggcccgaccagcttatactgctccatcttccccggccacatgccccgccaagtactgcacagggaccccccacccaggggccctgctccgtgagataatgtgaaatacgactgtggaccaaacgcaataaaacctctgtttgtacgaaga

SEQ ID NO: 384118 - DNA, 270 bp, Homo sapiens
cagatctacactgtagaaataaacagtaagactttggaggttgcacattggaaaagtgaaggaactactgatctctatatgccctgtgcttggcacatagaaagctggtgataattgtgcactgagtactaacgtcaggcccagcagagtccaaaaggactggggcagcattgctgcacttgaaggaaatggttcgtttttctcattcatacgaaagggctgtctctctcccagctgtgctttttgagggttgcatgtgcaccttgtaaa

SEQ ID NO: 384119 - DNA, 402 bp, Homo sapiens
cctaaaaaggagggaaattctcacacatattcagcatggatgaaccctgaagacattatgcaaagtgaaataagctagctacaaaaggacaaatatatatctccacttacatgaggcacccacttacataaggcacttacatgagtagtcaaactcgtagagacagaaagtagaatgataattaccaggggctggtggggaggaggaacggggactcagtgtttaaggtggtatgagtttcagtttgggacaatgaagaggttctggagatgactggtggtgatgggtgcacagtaatatacacacacttaatgccgctgaactgtatgcttaaaaactgctaaaatggtaaattttatgtaatgtgtattttaccacaataaaaagatgtaatttcactgc

SEQ ID NO: 384120 - DNA, 397 bp, Homo sapiens
cactgtgtgtgcttcaactcctggactcaagcttctcccaagatctcaggctgtttgcagtccctacactttgtccatacaactaaagtctaaggagagctgatagaggaagttttctctctctagggatttaaattagggatttaaatgtatcagaagactttaaagatgagaaaccgtttaagactccaagtaattaaataataaaataataaaagtattcctagcatgttgaaaggtgacattgggaacctgcttatttgctgctcagccatatgtctgagggattaacttattctgtgtgtctagcagctgccagacacccatggggatggctgtgggtccatgtgtatgcacatgtaagtgtgtgtgtgtgtgtgtgtgtgtgtgtgggtgt

SEQ ID NO: 384121 - DNA, 791 bp, Homo sapiens
tggtattggtattgtttttggaattagcaattgacatttggtgtttaattggtattaacatttacttaactttcagttaaacacaaatgtcaaatacaacaatttgtacaatactaaatacaatatcagtattgaagcaaaaatatatattccatttgccacctagtaactaggtatattcagcaatttgagtttagctaatgtcatcatttttaaacaatacatacataaataagggtgtattaagtcatattgcaaccttataccttaatttaaaaacttgattataaaattagtcatgcttgttttttaaaagtattttgaacaatgaaaaatgattttacttttaaaaaaatgcttcactttaattctttaagttaaaaaatagaatgtaacctgagatcctaaaattccttgtttattttaatttttaaaacaaattgagaggggacattagtacagattttgtcttcaaagtttcctttagaaaatgtcaacaacttaaatatttaaaaagtgattaactacttgcaaagagactaaaaacaatatcttaagtatgtgagtccccaaacatacatatttctgatttagacttttaaactgtcaataccagagagacaacgccactgatggggacctggcactagtccttccagttaattttttccttggagaatggttttgggcgacagagtggcgtccggcttcccaggttgttgcactgacaaactgcagtggtggcaaagtcaaggagtctgacaaaatctcattaatcattttaaattaaa

SEQ ID NO: 384122 - DNA, 551 bp, Homo sapiens
gttccccaggtgattctaatgcacacacctggttaacaaccatagttaaaaaaatgatgaggccaggcacagcagctcacgtttgtaattccagcactttgggaggctgaggcgggcgtgagccaccgggccaggtcagttactccttaagtatgcaaaagcactcaacaaaaaaacacctcaggggatcatgcctgctgggtggtctttaaaggaaatgggctactttcctatactggaaaaaaacacctgacagaaaaaaagacgctctagagtagctgaaaataaaatgcctggctaatgcagaacctgatgaagaaataggatgaagtgtaacattctactgaggtcatgatatcccagcataaggcagagttttaaatcttgtttctcaacagggggaggagtgggggccaaggaaggagcatcggaatcactagagacatttaaaatacagtcggccctccttatccatgggttctgcatccatggattcaacaaactatggatcaaaaacagtcagaaaaaaataaagaaagatataaataaaa

SEQ ID NO: 384123 - DNA, 271 bp, Homo sapiens
tctctgcgaaaaagaaacagaaatattagccaggcaaggtatcgcatgcctttagtcccagctacttgggaagctgagacgggggatcatttgagtccaagagtttgaggttacagtgagctatgattgcatcactgcactccagcctgagcgacagaccaagaccttgtctctaaaaaaaaccccaataagaaactgttatgatctgtgcagtatttactattgcatattgtcctacatgtacacagtactttcatatgcattagatcac

SEQ ID NO: 384124 - DNA, 434 bp, Homo sapiens
  misc_feature (39)..(39): n is a, c, g, or t
cagccatacccactcatttatatattgcctatggctaantttgaggcagagtatacagactgtatggcccgcaaagcctaaaatatgtactatctggttctttacagaagaagtttgccacgcaccttctggcttagaccgttaacatttgatataattattgatgtggttggatttaggtgtaccattttatttcttctgtttgtccctgtgattttgtttttgtttcactactttttgtttctgggtttattagtattccaaatagagtaatttagtattttattggctatctatctatatttttgaaaaaattcttgctctaggaattaacaatattcatacctaacttttcatggttgacccttgctgttcgagttctagattgtgcttccttcctttaaaattcactggcccttgttctggcaggcaag

SEQ ID NO: 384125 - DNA, 219 bp, Homo sapiens
ctcctattgtagtttggagctggttgtcctagtcagaacttgtatgggtctattttaagcaaccccccctaaggacatgaacaaggcatgagctctgctaagtaaaccctgttagcttatttagaattattgttgagacttaaacataactgttctctaatgtatgctaggttctccaattagtgccaacagcaagtgtgctctattaggccttaactg

SEQ ID NO: 384126 - DNA, 1344 bp, Homo sapiens
tttgagacggagtctcactctgtcaccaaggctgcagtgcagtggcacgatctgggctcactgcaacctctgcctcccaggttcaagtgattcttctgcctctgcctcctgagttgcggggactgcattcgagcgccaccacacccagctaagttttgtatttttagtagagacagggtttcaccatgttggccaggctggtctcgaactcctgacttcgtgatctgcctgcctcggcctcccaaagtgctggtattacaggtgtgaatcaccgcacccggccaagatccagtcattttaaagacagcagagtttgataaccaatctgattctttgtttatagactatgcttcaattaaaaatcattcacatgatcatttttaaacaattcatttgcattttatgcccttatatctaattgtggaaagaagaattctcataagtgtaaagaattttttcaaatattgcctcttaatgttgggaaggaggttggaatgcatatatattccttaatagaccagaacccaaggtcatgtcccagtccactcctctttttgtgctgtcagaaacataatatctcattagttactttggaatttcaaccttctctcttgcacctgttccacaatccgaaattctaataaaagccccacttctgttacttctgttaatatttgtggttattaactttctgataaactaatatattgcttttgttttatttactagcacttactctgctctagaattttgcctgggacctttcttattattaacaaagaatacatgtgaatatttattttaaaaatatatatcctaccttgttccaagaaaaatttaacatggcttcttaataaataaatgggttaattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaag

SEQ ID NO: 384127 - DNA, 551 bp, Homo sapiens
ctctggcaaacttgatccctcccccccgaccctagaggaaaaccggcgcctatcgatgccactttaagttatcataattaataaaaacagcatagaaacataattatgataacttaaagtggtaccatgaaacacacttggagaactagctcttcagtgttcataaatttgcctttgcaatgcctctcacaaaaaaaaattagtagtatcctttctgtaatgttaatgataaagtctaagattcaattctaggtttgccgaaaatgaatcctcacatgcctattaaggaagaagtcacttttttcataaaatctcttccctacctttttaatttttgcaattttaaaacttccttattaatgtaaaatgtagaataaatcagagatcaatatttgagcaacatactatttcgtttttgtttatagaaaagtgaaaactaaaattgaatgaaagcttgactttagccaaataatcaagaaaagttttgtgtcacttttccgtaacagccatttttttttccctgtaatagccactttttctttctttttaag

SEQ ID NO: 384128 - DNA, 319 bp, Homo sapiens
tttccaattattattttgccaatatcctcaactcttttgcccacttttatcttccattcaaccctccctgcaaaatcctgatctaaaagcaacccaagtatttgcctcttcaacctcccagctgctgagtggttttgggaattacacaaccactaagcttggtgcagatgcactatggcctcaatagagtcccccagtgctgcccactttctccttccatatttctccacagcagctggtcaaaatacatttctccccaaatgtcttacacaacccccttctctcttatcatccttacctcacccccaccccagttctt

SEQ ID NO: 384129 - DNA, 413 bp, Homo sapiens
atgggattgggctggggataagcctgaaaattctcttcacaggactgaaaaatcacttaaaaacttcagatcaatttaagcatttaatgtttagaagtttttcacatcatcttatacttaaacatctacacattgtatttcttcctgacacagtactgacagtggtgttagtaagatacagttaatttatttcttaaatggatatttcttcctgtattaatgaaacaaaaaatagatagtaagtgtgtagtatagtacttggtatatggtaagtactcagtaaacaccgtctcttttctttatatgtaatgaagtttgttaagaattttaataagatttatctgaaattgggtaaccggagcacttaatctttcctgccattatcaagcacccagttagtccacagcagtgac

SEQ ID NO: 384130 - DNA, 436 bp, Homo sapiens
acgccgcgattttgcctttggttccccgcgaagtccgaggcctggctctggagcccgcctgcgccccccagtggactcgcgagagggtgccgcgggcgagaagggcgcaggaaccgaggactccaggggctggggacttcgggggcggctctgggaagcggaaagcagtcagcggagaggaccccattctgggactgctcaggctccccaagacttgacgcagccccccacgcttctggaggtggggagggcctctggacagatgggtgtcccctggtgcccctccactcttctcttcctctcttttttggggggagaaacctcggaatttctatgagacctcccccagggagggggtcagttgggcccccatccctccccttgccacatcgcagcccctgttggaataaaaaaaagaacaaaaccccagaactgg

SEQ ID NO: 384131 - DNA, 700 bp, Homo sapiens
gctaaatcttccgggcagctgtctacactttggctcaggtcttgttctgtcacccaggctggagtgcaggggcatgatcactgctcaccccaacgtcaacctcctggattcaactgatcctcccaattgaatgattgttctgaaataccctctgcaggactcctttgtgatattcatcaaatatttcttgctctccaccctccagacacatggtaccatctgctgacttcccacatcagaagaatgatcttcaacccaagacacaggcaaagagagcatctaactgcttaaaatgagagcaggaatggctgttggcttagatagatggcaccccagagtcctgaaagaacttgcagatgtgatcacaggaccatctgaaccggagaaaccggggggaatggagagacagcaaaagaccggagatgggaatatgtgagcaggagagaagggtcatgttggagcagccaggactcagagcctttccgcagactgagtctggatcctttccttcagcctccaggaatactcccggctccacacccagaatggtaatccaggcaagggctctggtgtgtggccacactgccacctattacctgcgggtccaaatgcagtgactcaacttctctgtgcctctctttccacatgtataaaatgaggataatgttgctattgtaagaattgcatcaattaataaaca

SEQ ID NO: 384132 - DNA, 349 bp, Homo sapiens
ctgctctctagaaatacaattaaacaagcagcccctgtctctttttctccactttcagtcttggggaagggattggaatatgtgagcaggagagaagggtcatgttggagcagccaggactcagagcctttccgcagactgagtctggatcctttccttcagcctccaggaatactcccggctccacacccagaatggtaatccaggcaagggctctggtgtgtggccacactgccacctattacctgcgggtccaaatgcagtgactcaacttctctgtgcctctctttccacatgtataaaatgaggataatgttgctattgtaagaattgcatcaattaataaaca

SEQ ID NO: 384133 - DNA, 400 bp, Homo sapiens
ggcaggtttccaggggatccggcggaaggggggtgtggcactgcttctgccccatgccctgcccatgacagcccctccctgcagcagggggatctttagaaactgtacaccctcaaagcttcgtccatcagcaccccaggctgacttgggttcagagaggagacgtctgagttccttggacttctaacttcctcaggatcctccacttcccttctctccttctcatttcccactcttttttagtaatcttttgggatgggtagttgcatttcctttactcagatagcagagaagggaagcttgcttcttccgcaaacttttccagcaggaaaaatggagtcttgatgataaaccccagatttggagaatataatatcttgggaaggaggagggttggagg

SEQ ID NO: 384134 - DNA, 355 bp, Homo sapiens
gggcccaaggagcttgttgggacgttcaggagaccccgaggtgggaggttttggacacaacctgcatctcctcagagcgccttcgactctggaggccgccgtgtgacggcctgacacagggctgcggtgaggaccgaccagagagggatttccttttcgtcctcccaactaccagggattgagcactgggggccaggcaagggagaacatactatttcatatcaaatcagattctccacgttacctactcaagtcataagcgtctgaagaaagtgctctgtaaattctcagcagaatatgcttttaacaattctttaaaaacaataaagtcataataaatcttgatggcctgaat

SEQ ID NO: 384135 - DNA, 280 bp, Homo sapiens
gggcccaaggagcttgttgggacgttcaggagaccccgaggtgggaggttttggacacaacctgcatctcctcagagcgccttcgactctggaggccgccgtgtgacggcctgacacagggctgcgggagaacatactatttcatatcaaatcagattctccacgttacctactcaagtcataagcgtctgaagaaagtgctctgtaaattctcagcagaatatgcttttaacaattctttaaaaacaataaagtcataataaatcttgatggcctgaat

SEQ ID NO: 384136 - DNA, 386 bp, Homo sapiens
  misc_feature (345)..(345): n is a, c, g, or t
gggcccaaggagcttgttgggacgttcaggagaccccgaggtgggaggttttggacacaacctgcatctcctcagagcgccttcgactctggaggccgccgtgtgacggcctgacacagggctgcggtgaggaccgaccagagagggatttccttttcgtcctcccaactaccagggattgagcactgggggccaggcaagggagaacatactatttcatatcaaatcagattctccacgttacctactcaagtcataagcgtctgaagaaagtgctctgtaaattctcagcagaatatgcttttaacaattctttaaaaacaataaagtcgatgcggccgaaanccccaacaaataaattatcatgattctgagacgactaaact

SEQ ID NO: 384137 - DNA, 385 bp, Homo sapiens
gggcccaaggagcttgttgggacgttcaggagaccccgaggtgggaggttttggacacaacctgcatctcctcagagcgccttcgactctggaggccgccgtgtgacggcctgacacagggctgcggtgaggaccgaccagagagggatttccttttcgtcctcccaactaccagggattgagcactgggggccaggcaagggagaacatactatttcatatcaaatcagattctccacgttacctactcaagtcataagcgtctgaagaaagtgctctgtaaattctcagcagaatatgcttttaacaattctttaaaaacaataaagtcggatgcggccgaacaaaatattaccttaaattaccagcatatcggctagcaaaa

SEQ ID NO: 384138 - DNA, 386 bp, Homo sapiens
aggcccccggcgccggcattccgggcgtcgagcacatcttgacggcgcggcgcggcccccacttccggaaattaagggccgcgcctcagggcctcgaaatcctccgcgccgcctgaaggcgagtcccagccaaactaggttcaaaggacccagtggaggggaagaatgccggcgaggccttttctcggcaactcccccgtcgagggtcctccgggactcccgccacggactgggagaacatactatttcatatcaaatcagattctccacgttacctactcaagtcataagcgtctgaagaaagtgctctgtaaattctcagcagaatatgcttttaacaattctttaaaaacaataaagtcataataaatcttgatggcctgaat

SEQ ID NO: 384139 - DNA, 427 bp, Homo sapiens
agtaattattccaaagtcacattgcctatatgtggcagaagcagtattcaaaatggtggcactaaacctatggtattttgatgaagccaccttcaaaatattcacaacccagaagagacaatctctgtctctcattcgctcaacttctctctgtctctgacttactcaatcacacacatacacacacatgcacctagaatataagggaagatgtaatacataaataaataaaaggggggcaaatagtcacttatttgatgattttgagtatgtagatttgaagggcttccttaaatgcctggacatctggctgagtacagtagttcatgcttgtaatcccagcactttgggaggccaaggcgggaggctcacttgagctcaggagtttgagaccagcctgggcagcatagcaagaccctgtctctag

SEQ ID NO: 384140 - DNA, 237 bp, Homo sapiens
tcagcccttcttctactaaagaagtagagtggtatgctctttttagagtagccacccacacatacctttctcacattcctccttaagaagcaggaatgaacagaaatcacaatccatgaaaaaagaggaacccacaagtaaactgttgtatgtgtatgcagcatcagcaggtgagggtgaaagagaagctagggctcctgaatctacctgtcttgggtactcaaacagaccagggtg

SEQ ID NO: 384141 - DNA, 5298 bp, Homo sapiens
cgcggcgccgcgagaaacgccctaaagagtgaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384142 - DNA, 5214 bp, Homo sapiens
  misc_feature (14)..(14): n is a, c, g, or t
gtgcatggtactgncccggaatttaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384143 - DNA, 4957 bp, Homo sapiens
tcagaggactatccggctgccctgcccaaccacaagcccaagggcaccttcaaggactatgtgcgggaccgtgctgacctcaataaggacaagcctgtcattcctgctgctgccctagctggccacacagatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384144 - DNA, 5037 bp, Homo sapiens
cgcggcgccgcgagaaacgccctaaagagtgaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384145 - DNA, 4241 bp, Homo sapiens
tgccttagaatatcccagaggataggcacagtgttctctttctagaatttgtttagcaataaaaatgaaccgatccttaagttaatcaaaataaagcacttgacacattttcttccatgcttttgttttatagggaggcctttgtcttttctatctgttcgagctcataacacttcctccgacatgtgcactgtctgttgccttcattttctcctggctggatgggctgagagaagagggatgtgggagtgccgtgtgtggggattagctgcgtagagtgctgaatatctggtgtaatgattcacaatggcttgtgtttctaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384146 - DNA, 3062 bp, Homo sapiens
atcccctcaatcttatacttcccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384147 - DNA, 1978 bp, Homo sapiens
  misc_feature (20)..(20): n is a, c, g, or t
tctgctgtccccccgggtantgcgagatcgttgacccggcgtcggtaagtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384148 - DNA, 3622 bp, Homo sapiens
cgcggcgccgcgagaaacgccctaaagagtgaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaaaaaaaaaaagaagaccgtttacctagaagaagctatgtcaagaggctgaattatttttatttttaaaaa

SEQ ID NO: 384149 - DNA, 3229 bp, Homo sapiens
cgcggcgccgcgagaaacgccctaaagagtgaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagtcgcccttagttacctgttcctaactgtccttcctgccaaactactcaccccaccactctggctcatatccctgctctctttgaaatagccagtcgggtttagcttagattgtgcggtctggctccagccaatggagacaggacacagtagcagggacaagctgcgtaagggataaaaattgcttccctcggccaggcacgtgggtcatgcctgtaatcccagca

SEQ ID NO: 384150 - DNA, 230 bp, Homo sapiens
cccactattaactccaagcagcaaagaaatgatgtctcaagcattaaaagctactttcagtggtttcactaaagaacagcaacgactggggatcccaaaaggtatggttttgtagttggaaaaagagtggttggggtcagaccctttgggaagacacattttctcacctggagtgtgtgaggcagacgttacactaaccacattggagtcagcagctatgggccatggct

SEQ ID NO: 384151 - DNA, 5236 bp, Homo sapiens
ttgcgtgtactggtcctcggagttatgcatggcagccgccggcggaaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384152 - DNA, 4325 bp, Homo sapiens
acgtagaggatcccgatggcgggcgtcgtccccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattc

SEQ ID NO: 384153 - DNA, 3998 bp, Homo sapiens
cgcggcgccgcgagaaacgccctaaagagtgaggggagagcgcgggagggcgagagggagggagagcggccgggagatcgagagcgaacgaggcagccgccggcggagaggagggagcgggcgagggccgggcaggaggagcgggcgcggcgcgggcgaggctgggacccgagcgcgctcacttcgccgcaaagtgccaacttcccctggagtgccgggcgcgcaccgtccgggcgcgggggaaagaaaggcagcgggaatttgagatttttgggaagaaagtcggatttcccccgtccccttccccctgttactaatcctcattaaaaagaaaaacaacagtaactgcaaacttgctaccatcccgtacgtcccccactcctggcaccatgaaggcggccgtcgatctcaagccgactctcaccatcatcaagacggaaaaagtcgatctggagcttttcccctccccggatatggaatgtgcagatgtcccactattaactccaagcagcaaagaaatgatgtctcaagcattaaaagctactttcagtggtttcactaaagaacagcaacgactggggatcccaaaagacccccggcagtggacagaaacccatgttcgggactgggtgatgtgggctgtgaatgaattcagcctgaaaggtgtagacttccagaagttctgtatgaatggagcagccctctgcgccctgggtaaagactgctttctcgagctggccccagactttgttggggacatcttatgggaacatctagagatcctgcagaaagaggatgtgaaaccatatcaagttaatggagtcaacccagcctatccagaatcccgctatacctcggattacttcattagctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtggtaaactcgggggccaggactcttttgaaagcatagagagctacgatagttgtgatcgcctcacccagtcctggagcagccagtcatctttcaacagcctgcagcgtgttccctcctatgacagcttcgactcagaggactatccggctgccctgcccaaccacaagcccaagggcaccttcaaggactatgtgcgggaccgtgctgacctcaataaggacaagcctgtcattcctgctgctgccctagctggctacacaggcagtggaccaatccagctatggcagtttcttctggaattactcactgataaatcctgtcagtcttttatcagctggacaggagatggctgggaattcaaactttctgacccagatgaggtggccaggagatggggaaagaggaaaaacaaacctaagatgaattatgagaaactgagccgtggcctacgctactattacgacaaaaacatcatccacaagacagcggggaaacgctacgtgtaccgctttgtgtgtgacctgcagagcctgctggggtacacccctgaggagctgcacgccatgctggacgtcaagccagatgccgacgagtgatggcactgaaggggctggggaaaccctgctgagaccttccaaggacagccgtgttggttggactctgaattttgaattgttattctattttttattttccagaactcattttttaccttcaggggtgggagctaagtcagttgcagctgtaatcaattgtgcgcagttgggaaaggaaagccaggactgtggggtgggtgggaccgaattcttgagcaaattttcaggagagggagaagggccttctcagaagcttgaaggctctggcttaacagagaaagagactaatgtgtccaatcatttttaaaaatcatccatgaaaaagtgtcttgagttgtggacccattagcaagtgacattgtcacatcagaactcatgaaactgatgtaaggcaattaatttgcttctgtttttaggtctgggagggcaaaaaagaggtgggtgggatgaaacatgttttggggggggatgcactgaaaatctgagaactatttacctatcactctagttttgaagcaaagatggacttcagtggggaggggccaaaaccgttgttgtgttaaaatttattttattaaattttgtgccagtattttttttcttaaaaatcgtcttaagctctaaggtggtctcagtattgcaatatcatgtaagtttgtttttatttgccggctgaggattctgtcacaatgaaagaaaactgtttatatagaccccattggaaaagcaaaacgctctcactgagatcagggatcccaaattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgtgcgtgtggtcgacgcggccgcgaatttagtagtagtaggcggccgc

SEQ ID NO: 384154 - DNA, 434 bp, Homo sapiens
ccttgtcaagggctaaagctgtttagtagtggacaaggttaaaaatgcaagcttttctgatttaaagtattttcccttattctctaaggagcttgtcccacatcatagggccctgtagatggtgaaaactgcttattttaggtacaaatctctcctctctttacttgcaaaccctttgtttccaggctatggtattgagcatgcccagtgtgttccaccatcggagttctcagagcccagcttcatcacagagtcctatcagacgctccatcccatcagctcggaagagctcctctccctcaagtatgagaatgactacccctcggtcattctccgagaccctctccagacagacaccttgcagaatgactactttgctatcaaacaagaagtcgtcaccccagacaacatgtgcatggggaggaccagtcgtg

SEQ ID NO: 384155 - DNA, 273 bp, Homo sapiens
ttttagatcagctattacagagtatgtgttctaaatgttctaaagtaggtctttattaccaagtgactgtacaatattgcaattgccattaagaatgatattgacattaatgtatagttttattgctaataattcttttattttcaaattttctgtttagaaaaatatcatttgaaaaaatacagtttacttaaatatttcccgattatttgcagagggtctaaagagagtacttaccggtaatcagtggctctttattgcctttattttgga

SEQ ID NO: 384156 - DNA, 404 bp, Homo sapiens
gagccactgtgcacagccagttcgaaggttttgattcacatttccctgatggttaatgatattgaacatattttcatgtacctattggccatttgtccacctcctttgaggaaatgtcttcttaagattctctgccctttttaaaaattgggttattgctgatccataagggttctttgtgtattctcgttatcagtccattatcacgtgcgtattttgcaagcattttctcccattttgtatgttgtcttttcactttcttgatggtgtcattttaagcacaaaaattagccaggcatggtggcgggtgcctgtaatcccagctactcgggaggctgaggcatgagaatcgcttgaacccaggagtcagaggttgtagtgagccgagatcgccccacggcact

SEQ ID NO: 384157 - DNA, 410 bp, Homo sapiens
cagatagatataccgctgatcaaaataaaacagtggcagcaagaatgatgttctgtccatgtaagaaatcaatgaaatataattaagaacgaactgtatctcattgactcaaaacattgcatctgcctttctgtcccatctgttttctaaacaaaaatcttcccgtgctgcgtggttgtttttatttgtatcctagaaccatcctctcgagttccacaccgttgtattttctacacctaagcttggtgtgttctgcacaggaaatgtttcttggatgttttatcctcataccaagtgggaatttaaaatttaagagattacccacactctttgcctttctgtacatgtgatgaagaaagagtgggtgtaacccagcactctaaaatgtgtttgacctgtaaaaaaaaaaa

SEQ ID NO: 384158 - DNA, 395 bp, Homo sapiens
tgaagcagtgaggctgggaggactggggtcaaataagtacagccaggattatgtttgggggtttgatcctaaaacattatagttgagggctcctagcacttccttttagaacactggaaatagccttttttattattttctgtctctgttaaaatgggaggagggggattatcatgtgttccagttcaccaaagattattcttcccccaaatcagcaatagccagtagagggttcagcagcatagaatctgttttccctttttaaaaattttcaagccagacacagtggctcacacctgtaatcctagcatttgagaggctgaggtgggcagatcacctgaggtcaggagttcaagaccagtctggccaacatggtgaaacctcatctctactaa

SEQ ID NO: 384159 - DNA, 1045 bp, Homo sapiens
atgcagaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcatt

SEQ ID NO: 384160 - DNA, 1738 bp, Homo sapiens
atgcagaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaattaaatttgtgattgatt

SEQ ID NO: 384161 - DNA, 1611 bp, Homo sapiens
atgcagaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaattaaatttgtgattgatt

SEQ ID NO: 384162 - DNA, 223 bp, Homo sapiens
ctggatcctttccagagtttgtggagaaattcatgcaaggacagggtaggaacagcttctttacactgaattttttttcaaggttttataagacaaatgccatctccaagtaaaagtttttaactgttctggtacgttttcttccctgattcatagttaaaacacagaaatctaaaggcgcctggaggtttagagcaagcatactgtgtccagatgtagaagg

SEQ ID NO: 384163 - DNA, 1792 bp, Homo sapiens
atgcagaagtggttctcatctttttttgcagcttaagatctgccttggtatttgaagagatataaactagatcaatttctttcacaggatcaactaaacagtgtaccacaatgaattctgaacttgactattatgaaaagtttgaagaagtccatgggattctaatgtataaagattttgtcaaatattgggataatgtggaagcgttccaggcaagaccagatgatcttgtcattgccacctaccctaaatctggtacaacctgggttagtgaaattgtgtatatgatctataaagagggtgatgtggaaaagtgcaaagaagatgtaatttttaatcgaatacctttcctggaatgcagaaaagaaaacctcatgaatggagtaaaacaattagatgagatgaattctcctagaattgtgaagactcatttgccacctgaacttcttcctgcctcattttgggaaaaggattgtaagataatctatctttgccggaatgcaaaggatgtggctgtttccttttattatttctttctaatggtggctggtcatccaaatcctggatcctttccagagtttgtggagaaattcatgcaaggacaggttccttatggttcctggtataaacatgtaaaatcttggtgggaaaagggaaagagtccacgtgtactatttcttttctacgaagacctgaaagaggatatcagaaaagaggtgataaaattgatacatttcctggaaaggaagccatcagaggagcttgtggacaggattatacatcatacttcgttccaagagatgaagaacaatccatccacaaattacacaacactgccagacgaaattatgaaccagaaattgtcgcccttcatgagaaagggaattacaggagactggaaaaatcactttacagtagccctgaatgaaaaatttgataaacattatgagcagcaaatgaaggaatctacactgaagtttcgaactgagatctaagaaggtctttctttacttaacatatctgatattaaagatttcttttcattattctccactttttcttattttagattgctagaaaagacataatcatggattatgttgacattttctttttaaatttttgtttaactttttttttttttttttgagacagagtctcactctgttgcctaggctggaggacagtggcacaatcatggctgattgcagccttgacctccttgactcaattgatcctcccatctcagcctcccaagtagctaggactacagacatgtgcaaccatgtttggctaatttttttaatgtttttttgtagagatgaggtcttattatattgtccaggctggtcttgaattcctgggctcaagcttcccaagtagctgcaacaacaggcacacaccaccatgctcaactaattttatttctattttttgtatagacaggggcttgctatagtgtccaggctggtctgaaacccttgagctcaagtgatcttcccacaccagcctcccaaaatactgggattacaggcttgagcctccatgcctggcccaggtaacatgtttattgagctgtacatgcatatgagaaataagaaacttttttttcctactatcatctcttaaattttgttttctttttcttttgcttcctcttcttcttttctattttttataaatatcatgcacaactataacctatgggaatgatgtagtaacacagattattcatcttgttagagttgtattaaaaataaacaagcatttcaaattaaatttgtgattgatt

SEQ ID NO: 384164 - DNA, 342 bp, Homo sapiens
ggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatg

SEQ ID NO: 384165 - DNA, 167 bp, Homo sapiens
cgccactaaagaacaaacaccacgtgctccccacaactattaaaataaaataaacattaaaaaataggtctagagtgaggtcaactactgaggcctgggaaggaagtgagggggcaggtggggcccatctcaggcctctgggggccgaagggagccagggactaaag

SEQ ID NO: 384166 - DNA, 272 bp, Homo sapiens
aattccctattttacttgtacgtgtgtgtgtatttacttctatacaatttatcatgttaggcttgtgcgtctataaccacagtcaagatgcagaacaattccattgccacaaggatcctttgtgttgcccttttaaaaatcacaacccttccttcctcaccctcctcccacgtgcccatccgtcttcatggccttcactaatctgttttccatgtctacattttggcttttcaaaaatgttctatacatggaatcatgctgttgaaggacat

SEQ ID NO: 384167 - DNA, 464 bp, Homo sapiens
cagcctcccgagtagctgggactacaggcatgtgccaccatgcccggctaatttttgtactcagtagagatggggtttcaccatgttggccaggctggtctcgaactcctgacctcaagtgatctgcccacctcaccctccaaaagtgctgggattacaggtgtgagccactgcacctgccgtggtttagggttttaacgtgggctttcatttccaagtgttcctgtatgaattacaacccagtctccccatgatagggagtgtgagtccccgtagaaccagaacaaccgtcgtccttaccaagcactacacattagcttattgctggctgtgtgaccggaggagttccctgaccctctctgtgcctgttttcttatttttaaacaggaataaaaatacaggccagagagtccgtgaaatgcttacacgcatgctagaagctggctgtttttactgggggctct

SEQ ID NO: 384168 - DNA, 486 bp, Homo sapiens
tcgggaggctgaggcaggagaatggcgtgaacccgggaggtggagcttgcagtgagccaagatagcgccactgcactccaccctgggcgagagcgaggctccgtctcaaaaaaaaaaaaaaacttttaaaaactgggtgttttcattttctacactggtcagtcgtgtttaaaaaatggttaaactagacaaaagagccgtgccttcaggaaaattggtgatctgtatgttaccacaactgaatttattttccttccttaaagacccagattgatcactatgttggcatcgcccgagatcagaccaagtcaattgttgaaaagtaagtacatttagagaccacatcatcatgaggtatgcttccttccccccaattatctttagtcccttgtacaaaatgcagatgccaaggaaagtaattttcattttgataaaaaccttagttaatagtttcattttactaaaaattattatagctgcttctat

SEQ ID NO: 384169 - DNA, 3962 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384170 - DNA, 3904 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384171 - DNA, 3908 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataatggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384172 - DNA, 1986 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctccacagtaacgaccttccatagtttttcccttgccgcccgcctcgcccaatcgattttaaacttgggcaagcttatccttccgcccgaattcaagctaatttgcccaattcccctaaaggaggcccattcaaatcaatggccggcggttaacacgcccggatttta

SEQ ID NO: 384173 - DNA, 1749 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaa

SEQ ID NO: 384174 - DNA, 1776 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaatagtcgtgcgggtgtgggggggggggg

SEQ ID NO: 384175 - DNA, 1488 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttatcattaaaaaaaaagttggcggccg

SEQ ID NO: 384176 - DNA, 1430 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcacacattatggagggggatcctctag

SEQ ID NO: 384177 - DNA, 1362 bp, Homo sapiens
  misc_feature (33)..(33): n is a, c, g, or t
  misc_feature (1302)..(1302): n is a, c, g, or t
  misc_feature (1320)..(1320): n is a, c, g, or t
  misc_feature (1337)..(1337): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgacttatcctatgantttgattctttcttcttntgagttctaagatagtncttttatcagtccatcaatttttgg

SEQ ID NO: 384178 - DNA, 3205 bp, Homo sapiens
agtccaggactgtcctctagcatcacagttaaaataaaaacctagagcaaatgctaatgttttcactttctttctttttcccctccttttctcaataggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384179 - DNA, 253 bp, Homo sapiens
tgtacagaagtcagaagaaggccatccattcaagtgagttgaagtcttaaaagcaacattctacattttagtggaagggttcactgaagctgataggtctaaaactcagacctgactaaaaatcaagaattatggggcctaatgcagctgattggtggcatgaagcatcccctagagaccttgaaatcaccttaagaagtggccaagttagaagccaagaactttttgacaaattagaggctcatacttgaag

SEQ ID NO: 384180 - DNA, 436 bp, Homo sapiens
ctagatttggtttacgtatggggatcttatttacagaaaccattttggtaatttggaaattgttatttgtggtacaaagaaggtagcctgtatacctgaagaggttttttttgttttgttttaacactaccttaaattagctgtcttaattgggagtgctaaccaggatttctcattttgaggaatgcctgtgttttcctgtattttttgaggaaaaatgtatatgttactctgagtcttaagatgtgactgtctctcatatacacttgccatgtcccatgattctgtcttacagctgaactgctcattttcagtgtcccgattgtctatgagaagtacaaggtaagcatttatctgttccaaatcaaatgtgccagttgatgtatgactagttgtagttcatttctgagacattgaatgttcagagcagtctttt

SEQ ID NO: 384181 - DNA, 301 bp, Homo sapiens
gtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaacacaaacaatgactgtggcatcat

SEQ ID NO: 384182 - DNA, 2623 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaaatcggggtcccggggtacaactttcaacatggatcgtggctatcactgaggcaacaacaacaacagaaacagaaaacagaaaacacacagacacac

SEQ ID NO: 384183 - DNA, 3908 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaatcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384184 - DNA, 3903 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaaggatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384185 - DNA, 4019 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggattcctttgtttcttcctcttcctctcagcctgtatctctattttcgacctcacaagtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagctggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384186 - DNA, 3823 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaactggctgtcttcatgtggctgatgacctatgttggtgctgtttttaacggaatcacccttctaattcttgctgaactgctcattttcagtgtcccgattgtctatgagaagtacaagacccagattgatcactatgttggcatcgcccgagatcagaccaagtcaattgttgaaaagatccaagcaaaactccctggaatcgccaaaaaaaaggcagaataagtacatggaaaccagaaatgcaacagttactaaaacaccatttaatagttataacgtcgttacttgtactatgaaggaaaatactcagtgtcagcttgagcctgcattccaagctttttttttaatttggtgttttctcccatcctttccctttaaccctcagtatcaagcacaaaaattgatggactgataaaagaactatcttagaactcagaagaagaaagaatcaaattcataggataagtcaataccttaatggtggtagagcctttacctgtagcttgaaaggggaaagattggaggtaagagagaaaatgaaagaacacctctgggtccttctgtccagttttcagcactagtcttactcagctatccattatagttttgcccttaagaagtcatgattaacttatgaaaaaattatttggggacaggagtgtgataccttccttggtttttttttgcagccctcaaatcctatcttcctgccccacaatgtgagcagctacccctgatactccttttctttaatgatttaactatcaacttgataaataacttataggtgatagtgataattcctgattccaagaatgccatctgataaaaaagaatagaaatggaaagtgggactgagagggagtcagcaggcatgctgcggtggcggtcactccctctgccactatccccagggaaggaaaggctccgccatttgggaaagtggtttctacgtcactggacaccggttctgagcattagtttgagaactcgttcccgaatgtgctttcctccctctcccctgcccacctcaagtttaataaataaggttgtacttttcttactataaaataaatgtctgtaactgctgtgcactgctgtaaacttgttagagaaaaaaataacctgcatgtgggctcctcagttattgagtttttgtgatcctatctcagtctgggggggaacattctcaagaggtgaaatacagaaagcctttttttcttgatcttttcccgagattcaaatctccgattcccatttgggggcaagtttttttcttcaccttcaatatgagaattcagcgaacttgaaagaaaaatcatctgtgagttccttcaggttctcactcatagtcatgatccttcagagggaatatgcactggcgagtttaaagtaagggctatgatatttgatggtcccaaagtacggcagctgcaaaaagtagtggaaggaaattgtctacgtgtcttggaaaaattagttaggaatttggatgggtaaaaggtacccttgccttactccatcttattttcttagccccctttgagtgttttaactggtttcatgtcctagtaggaagtgcattctccatcctcatcctctgccctcccaggaagtcagtgattgtctttttgggcttcccctccaaaggaccttctgcagtggaagtgccacatccagttcttttcttttgttgctgctgtgtttagataattgaagagatctttgtgccacacaggattttttttttttttaagaaaaacctatagatgaaaaattactaatgaaactgtgtgtacgtgtctgtgcgtgcaacataaaaatacagtagcacctaaggagcttgaatcttggttcctgtaaaatttcaaattgatgtggtattaataaaaaaaaaaaaaaaaaactcgctcgtgccgaattcggcacgaggaacaacctgtgtgcatgctttttgagtatattaatcagggggatctccatgagttcctcatcatgagatccccacactctgatgttggctgcagcagtgatgaagatgggactgtgaaatccagcctggaccacggagattttctgcacattgcaattcagattgcagctggcatggaatacctgtctagtcacttctttgtccacaaggaccttgcagctcgcaatattttaatcggagagcaacttcatgtaaagatttcagacttggggctttccagagaaatttactccgctgattactacagggtccagagtaagtccttgctgcccattcgctggatgccccctgaagccatcatgtatggcaaattctcttctgattcagatatctggtcctttggggttgtcttgtgggagattttcagttttggactccagccatattatggattcagtaaccaggaagtgattgagatggtgagaaaacggcagctcttaccatgctctgaagactgcccacccagaatgtacagcctcatgacagagtgctggaatgagattccttctaggagaccaagatttaaagatattcacgtccggcttcggtcctgggagggactctcaagtcacacaagctctactactccttcagggggaaatgccaccacacagacaacctccctcagtgccagcccagtgagtaatctcagtaaccccagatatcctaattacatgttcccgagccagggtattacaccacagggccagattgctggtttcattggcccgccaatacctcagaaccagcgattcattcccatcaatggatacccaatacctcctggatatgcagcgtttccagctgcccactaccagccaacaggtcctcccagagtgattcagcactgcccacctcccaagagtcggtccccaagcagtgccagtgggtcgactagcactggccatgtgactagcttgccctcatcaggatccaatcaggaagcaaatattcctttactaccacacatgtcaattccaaatcatcctggtggaatgggtatcaccgtttttggcaacaaatctcaaaaaccctacaaaattgactcaaagcaagcatctttactaggagacgccaatattcatggacacaccgaatctatgatttctgcagaactgtaaaatgcacaacttttgtaaatgtggtatacaggacaaactagacggccgtagaaaagatttatattcaaatgtttttattaaagtaaggttctcatttagcagacatcgcaacaagtaccttctgtgaagtttcactgtgtcttaccaagcaggacagacactcggccag

SEQ ID NO: 384187 - DNA, 721 bp, Homo sapiens
  misc_feature (33)..(33): n is a, c, g, or t
agcggatgggagcgggcgttcccgccctctagntgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtagccatggcggagccgtcggcggccactcagtcccattccatctcctcgtcgtccttcggagccgagccgtccgcgcccggcggcggcgggagcccaggagcctgccccgccctggggacgaagagctgcagctcctcctgtgcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgccatggtgcacatcaacagggccctgaaactcattattcgtctctttctggtagaagatctggttgactccttgaagcataagaaacaagttgatacatcaagggaccatgtacgagaa

SEQ ID NO: 384188 - DNA, 502 bp, Homo sapiens
aagtcttactttcattacaggtagaaatagcttatatcatttgaaattttatctctcttagttttgtaatttcctattaccttacttaggtcattttaaaaagtctacttgtttaaccattttggaattgttgatttaaaggggctataatccataaacaaaataatttttgttttataaaactattgtcttataagattttaatacatttaagagggtttcatgtcgcctgggaatatagttcaagattttaaaacctcttttgaacaaagggtactatcgaatgtgaaagttgatgaaaaacagactaaaagttttgaatgactgctcactaaaattttattgcttaatgtatttgtagccttatgtctttttggaaaatataataacattattatgaaggtaatgtttaatcatttctcaatactttccagatagaatttttgtagaacttttagcttaagtttctttttttaacataataaattctgctttgattgtc

SEQ ID NO: 384189 - DNA, 338 bp, Homo sapiens
ggtggcacatgactatagtcccagctacttgggaggatgaggtgagaggatcacttgagctggggaagtagaggttgcagtgagctgagatctcactactgtactccagcctggatgacagagtgaaaccctgtctcaaaaataaataaagaaagaaagaatataaatattttgtatcaattttcagcttttacagtcaatgaacttaagtcttaattttggttacagaattaaatattaatattaacaatcaaggcaatgtaaaagtaaagtacagttgactgaagctgggacacagacgaaaagagagtgaatgaaaagaaggatactaatattct

SEQ ID NO: 384190 - DNA, 238 bp, Homo sapiens
aaaacagcggcccctgccctcttaatagtaaaaaaaaaacaaaaaaaaacaaaaaaacaaaaacgtagtttatcactgacttacctctgtaaccataaagtaagccctctgacctttgttgctttctttggactgtattctgctgactgagtgaactatattgggcattttccaaaaatagttgagcaattggaaactaggtaatttagacatgggtacattagtactctgtagttct

SEQ ID NO: 384191 - DNA, 430 bp, Homo sapiens
cctgggttcaagcgattctcctgcctcagcctcccaagtagctgggattacaggtgcctgccaccacgcccagctaatttttgtatttttcatagagacagggtttcaccatgttggccaggctggtttcgaactcccgatctcaagtgatctgccagcctcggcctcccaaagtgctgggattacaggcatgagccactgtgcccagccccagtttgagttaattttcatatgaacgtgtaggtctacggccatttttgaacccatgagtctgctctagcatggcttgttgggaaagcggctcttctggcattgacggctcttggtcccttgtgggaggccaggtggccgtgatcatgggggtctgcacgcccctttacctccactctctctcttccctggggtgacactctctttttcaattttctat

SEQ ID NO: 384192 - DNA, 531 bp, Homo sapiens
atctagtaagaaaggaaaaaggaaagtggtatattcttaaagtaatgacagattgttggaagagatgatacaaactttttaaaaaaaaatgccttttaacaaatattaaaacctgcaaaatggcacttgtggtgattattctggagaataaacagattacataagattttgtcaggtgacaaatgtacattaattctgcatttgttaattctagtgcttgagatgttatatatagagagagaagtcataaatggtattttttagaaaattctatttactgtattatttgagaattttatttggaatataatgccctcatctaatttctgagaaaaatattaaagtctgttgatagaataaggccaatatggggcctgagtattttcagcgtcatttaatgttaaagttctatccataaaccaaagtcatttaacataaattttggataactattagcatacagtttaagattttatttctctgctatacaagttaatgtgggagtctaaaatgcaaaaaaaaaaaaaaatt

SEQ ID NO: 384193 - DNA, 295 bp, Homo sapiens
gatgtgaagaaaaataaaaggaattcagaaagaatcatgtatctaatatccaggagataatgtagttgcattgattgtgttgtaaagaagaatatatctagcattagtaatggcaatggcaataatgatgacaataatacagattgcattgagccatatatacattatctcattccagtataaaagaagtgcccccagcaacttcttggacgccaaggaggtttccaaattatttattttacaaactcttactttattcccttttttttccttcttctttttttttttcccccaa

SEQ ID NO: 384194 - DNA, 513 bp, Homo sapiens
gggcggggggcggggcttctccatgaggccaaaggtgagcaggcctctgggtgtttcagaagaactgccctggcaacatgcaagtacagttctagcagagacgccaaatcaactgtcaaaaccgagccactgccaccccacaaagccaggaaaagcttctaactgacaatcttgggtaagtcggccctcagcctctgcatctcccaccacagaccaaggctcccagatccccccagcccatgcactccatgtggtcccctctgtgtgcctggatacatcgggactcttgggtgtcactggggattcctgccctgccacatggggtaagctactggtaattactcagctgtgggagctcctggtcatcagccttcaaacacagaaactcaggtatttttcccagcagaccctgaccagcctctgtatttctccataacgctggtcggctgggcacagcgatcttggcaacagattttgcgaaataaacttggtcagtggatcccagtcaacaaa

SEQ ID NO: 384195 - DNA, 346 bp, Homo sapiens
ctccaaaacacctttaaaaattatttgtgactaaatggatatataaatcaaatcatgtcacatctctgctcaaaaatctgcattggctctccgcttctctcagataaaagccaaagtccttacaattggcctacagagctctaacaccatctggctcctcaaaacttcgtctctttctactctcccatcactacctacatacctgcttctttactgtttaccaaacatgccagatacagtcctgctttaagggctttgcactgactggccggcccctctgcttgaaatttgttttctccacatggctgcagttgttaactcctttatctcctccacgtctttgctc

SEQ ID NO: 384196 - DNA, 671 bp, Homo sapiens
atacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384197 - DNA, 1705 bp, Homo sapiens
ctccggggccggccgcctgggagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctgggtaaatataaggagcaagggcgcacagagccccagcccggcgccaggcggtggagcagttttccggcactggctccgctgacctacgataattatacgacggagacctaacgcaagcgacctgctgccttccttcccactgcttgtcttcagtgtgcccggctgggcaggggtgcggtggtggtggccgatgaggacaggaaagggagatagccagggcgaggtggggcgagggctccttcccccaagcaacaccgcccagccctgctccaggcccctgcactccgcccacccctaccctggctgcacctgagcttgctgcccctggggatgttgcccagtggctgtgcactgctctgtgcacgtgcgtgtgtgtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgtgtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtggggg

SEQ ID NO: 384198 - DNA, 1997 bp, Homo sapiens
ctccggggccggccgcctgggagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagcttgcatgtaccgggggacatcagagatgcaggcaggtgcccctgaacggtgcccacagtctttccgtacacagccagcatcatggcgtttggagttgaaaggcccacagaggacatcggctcccagggcgcccagctgcaccccttcagaagtcgtcacgatccctcgtgcacctgttgaagccacaggcgctaccctttgtcattctccttgtgcctggtactccctactagtttgtttctctccctttgggtgacgtaccatttccttggtctggcctattttcatgtcctaggccagcaccttgaaggagcagttccttctcttgcttgaccctggctggccaaccacagagctctgatttcccactgctgtttgtttccctggctatgtgtggcaccatctctgtggtgaagtcacaggtgcaagcccacgtggatgcagacgtgcacatgtgtgtgacgtttcgggtttgtttccatcctctccagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384199 - DNA, 930 bp, Homo sapiens
actctccagtgaagctacgacagtaagacttctgtttcagctgaaaaaggaagtcaggaccgtagctcatgaaaaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384200 - DNA, 1980 bp, Homo sapiens
ctccggggccggccgcctgggagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaaaaaaaaaaaaaaaaacaaaaaaaaaaaaaaaaaaaaaaaaaaaaaaaaaaaaaaaacaaaaaaaaggggggggggcgccaaaaaaaatccccccgggggggccccacaaattacgcccccccctttttttgtaaaaaggggggccccaaagaggggagcgccttaaaaaaacagcaaggccgacgggcgcgcgctataacaaaacaagcggtctgagtgagggagagaaacactgcgctcatcgcggagggcaacaccttgtgagaagagaaacccccaacatctcgggggggggggacaaaatgttgtcgggcacaactctcccacgaggagaaattatagaccgcgctactgggggcgacaaacatctaaactactcacgcggtttacttgtgttttcaacccaacagcacgatatatattcttccgcataaaaaactttggcatcgaggtagtactataggaaactttcac

SEQ ID NO: 384201 - DNA, 406 bp, Homo sapiens
gtgtccatcccccttcgtgtgtccatcccccttcgtgtgtccatcccccttcgtgtgtccatcccccttcgtgtgtccatcccccttcgtgtgtccatcccccttcgtgtgtccatccccctgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384202 - DNA, 1505 bp, Homo sapiens
ctccggggccggccgcctgggagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384203 - DNA, 460 bp, Homo sapiens
ccaccatgggaatgcatgaactatatctgccggctgtacatcggcaacttcaaagatgccagagacgcggaacaattgagcaagaacaaggtgacacatattctgtctgtccacgatagtgccaggcctatgttggaggacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagttggctgaaggaaggctatgtccaaactgggtcttcggcaggttacaggagaacgcgtcaacatcg

SEQ ID NO: 384204 - DNA, 1577 bp, Homo sapiens
agcgggtgtgtgggcccgcgggggcgcgcgtggctggggggcagtgagggtcgcctcggcggcgagcagcacagcgggaacatggcgcccggaactggcgagcgcgcctagctggcgggaccgttagctcgaggcggacgcggcccggacccggtggatgtggagcagtcgccgctgccggcgcccaagccgaccccagggccgacccccgcaaggagctgaaggaggtgggagccccagtcgccgcgggcgtcggcgccgtcaaagaagatggccacggagacagcagtgtggtcagagtggtggagctggtcatcggcgagagctgctccatgtctgtctgctgagtgctagagcctgtggcccactggcttgcctcactgtggttgatggtggcggtgacagagactgcagcacgaccagagtggcttttctggctttgcccacccagctgctccatgccaggaggaggaggagacacctagagcctgcgaacaccacgacttgcctcactgcgggtgggtggcagcgacagagactgcagtgcgccagagcgatcctgcccggcatgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaa

SEQ ID NO: 384205 - DNA, 1568 bp, Homo sapiens
ctccggggccggccgcctgggagcccgagcctagtgcctcccacgcccggcggccgcgagccggggtccgcgagggcggagtggggcgcggcagccaggaacccgactacgaatcccagggtgcgggcgggcggagcgaggagggacgctgggcctgcccggtgcgcacgggggcggggaccggcaaggcgggaccatttcccggcataggctccggtgcccctgcccggctcccgccgggaagttctaggccgccgcacagaaagccctgccctccacgccgggtctctggagcgccctgggttgcccggccggtccctgccgctgacttgttgacactgcgagcactcagtccctcccgcgcgcctcctccccgcccgccccgccgctcctcctccctgtaacatgccatagtgcgcctgcgaccacacggccggggcgctagcgttcgccttcagccaccatggggaatgggatgaacaagatcctgcccggcctgtacatcggcaacttcaaagatgccagagacgcggaacaattgagcaagaacaaggtgacacatattctgtctgtccacgatagtgccaggcctatgttggagggagttaaatacctgtgcatcccagcagcggattcaccatctcaaaacctgacaagacatttcaaagaaagtattaaattcattcacgagtgccggctccgcggtgagagctgccttgtacactgcctggccggggtctccaggagcgtgacactggtgatcgcatacatcatgaccgtcactgactttggctgggaggatgccctgcacaccgtgcgtgctgggagatcctgtgccaaccccaacgtgggcttccagagacagctccaggagtttgagaagcatgaggtccatcagtatcggcagtggctgaaggaagaatatggagagagccctttgcaggatgcagaagaagccaaaaacattctggccgctccaggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtcatgtttatgttgagaactaaggatattctttagcaagagaaaatattttccccttatccccactgctgtggaggtttctgtacctcgcttggatgcctgtaaggatcccgggagccttgccgcactgccttgtgggtggcttggcgctcgtgattgcttcctgtgaacgcctcccaaggacgagcccagtgtagttgtgtggcgtgaactctgcccgtgtgttctcaaattccccagcttgggaaatagcccttggtgtgggttttatctctggtttgtgttctccgtggtggaattgaccgaaagctctatgttttcgttaataaagggcaacttagccaagtttaaaaaaaaacgcagcaacaacacacacacaacaaaaacgcacaaaagaaaaaaaaagggggggcc

SEQ ID NO: 384206 - DNA, 293 bp, Homo sapiens
ttcccaggagctgggagacctcacatcctggcggagcctctagttctggctgcacagacctgactagcctggcctggccgcagtagctggccctgagtagtgacccgctcgcccgctgccctcggaagcctcacttggctgacaaacaggaaggtggcagggctgcctgcgtgcccttgccgcccccacagccctgtgtctggccccaaccctcatctctactcgcggctgcggtgaacttggatggtgctactctcaccacaaaccacagtccgtcacaaattgccgtgtgg

SEQ ID NO: 384207 - DNA, 420 bp, Homo sapiens
gaacctgtggggatattaagatttaagtcaggatgattggttcttgttaccagcatcaaaggatcttctcatatcacaaaataatgagattatcccccaacattggtcagcatggcataaaatacatgatctgtgataggagatgcttttctgatccgcttttatgaaaagtaaatgtccttcctgcctgcattttcaactttagtatgtgtgcctgcctttttctttttaaaatgtggtaagcttcacccaccagcctttagtaccggctgtataaggagcaactaacaccaagacatacatgcttatgccccatccactttattttaaagcactcttcaatttgtcaatactttaattctctaagcagtgttatagtggctgaccacttttgaaattatctttgttttgtttggtact

SEQ ID NO: 384208 - DNA, 328 bp, Homo sapiens
cagaaacatgtcagggagtttctaggaaggaggccagaaatcatgcagttagcaagggagatccagctgtgcccacctcagcctgagagttttattcacttcttctgcagggatcattttcagccgttcaaaaagtttcctactgtttcacctcgatggggactttacttgcttttctgtgcaggttctctattagttaacatgttcctctaccccatttaacttttgaagtgtggggcctctgaatgagaaaatggattgcgtcttccaatatcaaaatggagtcctactcatgataagtagtttaacacttttctgagagtattga

SEQ ID NO: 384209 - DNA, 323 bp, Homo sapiens
ttctcttgaccctaattccctaaattgtacttttaatggattatatgtgaaatcatatctgtgtctggatacagacatcccagggaaacaaggggaaatccatcatctctactctcctccactctgcagcaagctgaggaatgctcccatcagaacagcaagtgggcacaggcagtgtcctccctgcacacccagccacctccttccatgcatgcattccagctcagctcagcagctaaatgcattatgtgcagaagcacagaccacttttctcagagtaggaaaaaaaaaaagtcgacgcggccgcgaatttagtagtagta

SEQ ID NO: 384210 - DNA, 882 bp, Homo sapiens
ttggatgacaagggctcgagcctcagcgcctgtcctgattctgcaaagtctatgaagagtagtgtttcaaacggacattgccagcaggagagatgaggcttgttctgtttgggaaagacctgttcataacgccaagcctgccatcccaaagcacatagtcagggggctgaactctcaaatcctcagtgtctattttcatagcaacccttctttgatacttactgcccctcaaatatattttatatcttattcacttatataagcagaaaagcccagaccaaaatgtaactgaatttttatgtttttaaatacaaaatttaaaatgtatgaacccaaactgtcgattggaactatgcttttaactcttagtgcggagtgcatccctctggagccacacatcatgactttaattggttaatggacgtaagattgacttacaaaactataaatggcattttctttaaaattccctcttaatccttctgattccatcaaggagcaagtctccgttgttactagtatatttccatcatacactgctctccccctttaaaaagaaataaccgatctcaaattcagtcttctgcagaaaatatatctggttagtcttcagttacgttatattgattctgttgtatttcgttttatggttacctatgtgtaattggtctccctgagtttcatttatgactgtaattaaaacatttttaaataaatgtaattaaaactaatgaatctgtttaaaaatgttaggcatgtgatattgcaggtagggcatggacatggcgaaaaaattttgaaaatcatttgagaatgatggaacttggtggggatattccctagcagtgacagcatctactgcagtccttcctatattccacg

SEQ ID NO: 384211 - DNA, 464 bp, Homo sapiens
tttttttattttgagatggagtttcactcttgttgcccaggctggagtgcaatggtgcagtctcggctcaccacaaccttcacctctcgggttcaagtgattcctgtgcctcagcctcccgagtagctgggattacaggcatgtgccaccacgcctggctaattctgtaattttagtagagatggggtttctccatgttggtcaggctggtctcgaactcctgacctcaggggatccgccctcttcccggagtgcacggattacaggcatgagccactgcagccgaccaaaactgatataatttttgtgtatggtatgaggtaaaagttgaagttcatttttttttctatgtgactattcagttgttttcgtaccatttcttggaaaaaagaaaaaaactatctttctccttttgaaagtccttagtatcctttaagatcagctttccttatgtattcacatta

SEQ ID NO: 384212 - DNA, 988 bp, Homo sapiens
aaatgacagagagggagtggccagaggggaacataagagaagagagggttttttgccggcaaaggagatttgagctcatttataggcatgggggaagacaatcagtaggtgcataagtgagttgagaatctatactagcaatacaggaaaccatgttaggatcactgtctcaacaaaaatgatcacagccttccaaaaatgcaacttgactttaaaaaggctttcttttatcacttgcaagaatattgctgtgacacctaataaaaatttaattaaggcttagatgatatcacgttttatgtaacctgaagtccttaaatccatgaaatcactcaaatagaatcaagtttgttggaaagagaatctcatcttaagaagtggcagcaggaaaaatgagtaagttccattttattttatcagtgaagtctggggctacgaaatggttctaacagcataaagaaataacagctgcattcaagaccaggatatgtaaaataatttgtttagtttcagccactttttaaagtcaattttacaccctgaaagaaaggcaatcctgactccattgttctttcgccaataaggagatcgggaattacaataataaatagaagaaagaatgttgtttttcctcactgtaattaattttatggctcttgcgaagatgaatttttgtggtgattaaaatagtcccttgcacatattaggtactcagtaagcatttgtgaaatagggactttctagcctttatttgtgtttaaggaatcagggaataagttcaaaattgcctttcaagaaatttttggaactctcttctcactaagaaactgtaaagtcttataaaagagacggacgcattcacccgtgtctgttcactgaccaaagtccacagtttgtcaaggttgacagttgggcagaagctctggttcctctttaagtgtaatgcttcataccactttcccaaagtagcctgatgtccgtcgatgat

SEQ ID NO: 384213 - DNA, 556 bp, Homo sapiens
gtgtacaaaatacacctctaacatgaaacactcatggaaaacatgaatagagcatgtgccaggttggtgctgggcacactgaggcaaagggtacaatgcttgtctttaaagaatttactggctagctgggaacacatggaaggaggcaagcaggtaaaatgcagtgtgagcagcaacagaagtcagtgagggaacactgggtgggaaggacagccaaggcttcctttaagggtgtcttctgggctgaatcttgaggataaggatgagtttatcaggtgaacaaactggggaaaggcattccaagcatgcaaaacagcttatcagttcaggagagagtctcagctgggactatcaatctggtggccaggctcctctccaggagacagtgactacagtcatagtcagaagtagctaccactagtgacttggggttaatggtggcactggcatggttagtacaagcagctaggctccagtcttggctctgccactgtatgtcctgggtaagccagtgcactactctgtgactcactttccttgtctttgaaacgggagg

SEQ ID NO: 384214 - DNA, 480 bp, Homo sapiens
acagttttgagtatatggctgattggttttggtcagctactcaaaactgtgaagagaaaaggggatagaactgagggatgcctcccagtagtttctctcttatttctttcagtcttcagaaggggtcagggataggctgagaaaaaaggtccccggaaatggtggtccatttggttttttttaaaccaaaaggcggcatctccaggttcaaccaagagctggttacattgctataagtcagggagagtatgaccccaggacaattctgaattgttcagtaaattttccttttcctttcctttcacgggtgacggcatataaatcagaccaagaccgaagtttaaattatgtctctttcctcagtctagcttgggaacaggggcctgctgtaccctggcttcatctgtaggagatcagggcccaatgaatcttaaggttacagggagttgaggggcattgaggttcagttggcagaggaca

SEQ ID NO: 384215 - DNA, 440 bp, Homo sapiens
cagatctgcattgtaagaaaaatgagaagaattccttcaggaagaagaaaaatgataccagatggatatgtggatccacataaaggaacgaagagcacaggaaatagtaactatactgtcttgctctgtcacccaggctggagtgtggtggtgcgatcttggctcactgctagactggttggatccagaggactcggcaatgaagcatggacccctgttgaaaggaaaaatttcaattgcacaagaagaaaatatgctgaaatagactacagaatatttagatcttggccactgagtgaaaatatgctggaatagactacagaatgtttagacccaccactctcctaccgtaaaatacaacccggttctggttggattggccttcacctgcctaacctattttccttggtcttttcacactctgtgatttaatatttatt

SEQ ID NO: 384216 - DNA, 705 bp, Homo sapiens
tggatgtgcagtgtgtagttttatttgtttttatttccataacacaagagaggaagcgaagggccagggcatggcatcccctgcacggttcgaaggctttcaaccgtcccgggtttgttttgaaggcaattttggggccgcgccaagggaaaccctgcaggctgtcagtcccagcatgaacagcttaaaataaaaatctcccgtctggttgctgctcggagaggctccaagaaatgcaaaacaaacccgcctggaaaatgctgccctgagaaccagagcgagggcttgaaagatgccttcaacacagactcttctaggaatccagccagctttgggacggccgtttcacaaaaccaaaaaacaccaagtaacatttctaaccggagaattgccggttttagcaagaaaaaggggcttcacctaaaagggagggtcacaaaacacgaagggggttccccctggcgcctgcctcttcctttctgagcagatccgtccgagactgtggagcggaatcgccaccctggcaggagggggcgcagcagccggtctgggtgggcgctcactgtttgcccgcctgtctgccaggcttcttctctggctggcctctgcctgtgcccgggatcccacctcggccccggccaccaaacacacctcggccagcgccgcccatgccgcggcctttctgctgcttctgctgctgcaggc

SEQ ID NO: 384217 - DNA, 769 bp, Homo sapiens
tggatgtgcagtgtgtagttttatttgtttttatttccataacacaagagaggaagcgaagggccagggcatggcatcccctgcacggttcgaaggctttcaaccgtcccgggtttgttttgaaggcaattttggggccgcgccaagggaaaccctgcaggctgtcagtcccagcatgaacagcttaaaataaaaatctcccgtctggttgctgctcggagaggctccaagaaatgcaaaacaaacccgcctggaaaatgctgccctgagaaccagagcgagggcttgaaagatgccttcaacacagactcttctaggaatccagccagctttgggacggccgtttcacaaaaccaaaaaacaccaagtaacatttctaaccggagaattgccggttttagcaagaaaaaggggcttcacctaaaagggagggtcacaaaacacgaagggggttccccctggcgcctgcctcttcctttctgagcagatccgtccgagactgtggagcggaatcgccaccctggcaggagggggcgcagcagccggtctgggtgggcgctcactgtttgcccgcctgtctgccaggcttcttctctggctggcctctgcctgtgcccgggatcccacctcggccccggccaccaaacacacctagaggacagagagagggcgctgcagcagagccaggtacgtccactggagaggggagacccacctcggccagcgccgcccatgccgcggcctttctgctgcttctgctgctgcaggc

SEQ ID NO: 384218 - DNA, 715 bp, Homo sapiens
tggatgtgcagtgtgtagttttatttgtttttatttccataacacaagagaggaagcgaagggccagggcatggcatcccctgcacggttcgaaggctttcaaccgtcccgggtttgttttgaaggcaattttggggccgcgccaagggaaaccctgcaggctgtcagtcccagcatgaacagcttaaaataaaaatctcccgtctggttgctgctcggagaggctccaagaaatgcaaaacaaacccgcctggaaaatgctgccctgagaaccagagcgagggcttgaaagatgccttcaacacagactcttctaggaatccagccagctttgggacggcctttagcaagaaaaaggggcttcacctaaaagggagggtcacaaaacacgaagggggttccccctggcgcctgcctcttcctttctgagcagatccgtccgagactgtggagcggaatcgccaccctggcaggagggggcgcagcagccggtctgggtgggcgctcactgtttgcccgcctgtctgccaggcttcttctctggctggcctctgcctgtgcccgggatcccacctcggccccggccaccaaacacacctagaggacagagagagggcgctgcagcagagccaggtacgtccactggagaggggagacccacctcggccagcgccgcccatgccgcggcctttctgctgcttctgctgctgcaggc

SEQ ID NO: 384219 - DNA, 470 bp, Homo sapiens
cagagaggtgaggaagggcaggggctacagatggcccctgggcctaacaaatggaattttatgccaattcatcatctccggtgggggcgggcgaccttggctctggatagagccacgccaggttccaagtggagttgccagcggcctggacagatgggcaccaccataccctctcagaggggaaactgaggcttggggaggtgacttgatgtgccctgaggaccgccaggaggcgcagtgagaggagggctgagtcccaggtctcggggctcctctgcctgggcctcggctcatggccaaggaccaggaggggggcccgggagggttgggaggctccgaggcagcgctgcaagggcaaccccaagaaggagggatgccacgtgtggctgtcttcccgccccaggtacgtccactggagaggggagacccacctcggccagcgccgcccatgccgcggcctttctgctgct

SEQ ID NO: 384220 - DNA, 442 bp, Homo sapiens
gaaaggtagtgtgctgtgtttagggagtgccctagatgatcaaagagaaaaagttgatttgcagcttgactatatcagggaagccttcttgagagaggtgacatttgagcaaggtcttcaagaatagctctaatttgaaggatgttagaacaaatctagagatctaatgaacaacaagatcaatacatttggtgtaatagaacaaatctagaaggctaatgtatagcatgaggactataggaaataaggttgaactgtatttgggattcatgctaaataaccagattttaaatacttttggcacaaaaccaaaagaaaatggatgacttaagataatggatatgttaatttatttcactataataaactgtttgctatctatatgtttcccataacatcatgtctaccttaaatatacacaataaaatttacctgaaaaaag

SEQ ID NO: 384221 - DNA, 688 bp, Homo sapiens
taagtaactacaaaattattgaaaagagtcctaacaaggatagctccctgatgtgccaccataccagggcctcactgggctcatcacgcgacccgatcacaagggaagcaccaggcgtgcttaggacactgagtagaatttggcagcagcatagaaaatggaggaggatcggctcgtctcattgacaaatgatatctgtccacatgaatgtccagaagtcggttttaaagagtctgaacacttaatccatttttatacagactttttttgttttgttttcctaatcatttgattcagtgcctgattgaatcaagctgattgttggatcgtttgagagttgttcattgaagtagtctatttacgccttgctttgaatttatatatttaaccagaatcacagaatttttaaactggaagggacctcagaggttcttctgggcaaaccttcatttcttctgaaaaagttaagtgactttgcataactaatacagctattgcatgacaaagctgaaactgtaacctcgtctctaggcttcacttttttaatctctgtgatatcttggtgcaataggagctttttgattcaatattttaattttggagagtcatatgaattaataattcaaatcggatgtggagactagtgatcaagtagacttaggcaattacaggccataataggtgggaa

SEQ ID NO: 384222 - DNA, 3754 bp, Homo sapiens
  misc_feature (253)..(253): n is a, c, g, or t
  misc_feature (471)..(471): n is a, c, g, or t
  misc_feature (494)..(494): n is a, c, g, or t
  misc_feature (605)..(605): n is a, c, g, or t
  misc_feature (845)..(845): n is a, c, g, or t
  misc_feature (1373)..(1374): n is a, c, g, or t
  misc_feature (1381)..(1381): n is a, c, g, or t
  misc_feature (1417)..(1417): n is a, c, g, or t
  misc_feature (1521)..(1521): n is a, c, g, or t
  misc_feature (2963)..(2963): n is a, c, g, or t
ttggttgctggtccacttacaaacacttttcatatttgtatgtctttccaatggttatcctgttttgttcatttcaggcatatggccctgatcagattaactgacatgatgtatatgcaaagccttttgagttcttcagaaaaataaattatcttattcaagactgattgcttataaggaacttattatagctaatatagtaggcacaattttttttgtaattctcctagatgagtcagaacttagttttgangtaggtaaaaattttatggtcacaaatctcaggtgtgagaaaatctctttccttgatactctatataaatagaggatataaatatttcaagtctggaagtagtgagagaagctggtaattctggacatatagtgacagtcaaaaaggagctcaggtacaggactggtctaagctgctcaagattcaggagacagccagtacacagagaagctgagganataataagatatatctaaaacanttatctaaccttctgtggtaacaagctccttaaaggggctggatgatgttgtgttcactttttatcaccagcaaaggctaagataatgtatatagtaaatatttagtaacnatttattaaataaataaatatttaagacagaataaacaagtataataaatgaaccaataagaatgcaccatctaagtcaaaatagccacttttatccttaacattgtacctgctttggctgctgcagaagcaaacttgttggcattagacaaatcaagctggtgatttaataaattccaatgtaagtcttaccagtattgatgaataactatccagcactcaccatgaaagttaaagaancaacacagaaaaagttcctaagtggtcccaatttgaaatgatcagataacctataaaagaacatattcatattatactaacataaacacatataaatgcacttacagcagttacacagtattctcttcaataactagtttccttatgcattaatgtgtaataacagcaactacaatatttagataattataaaaaccaaggcaataatttaaaaactgattaaccgttttactctaacttaagcatggattggatcagtaagattgattaataaatttgaatgcagtcagttggattgattctaatttaaagttttaatttgttgtagaataattttaagtgaatatatttgtccagtgttcgagtgctcaacagtgtgtttgaaaaggaaaacaaagaatgttttgagaatgtgttaattccttaagacaatggattttaattggatctgttgttttcatttttcttcattatcattatacatctgtatgttggacagaacactaacactaaatagtttttagaaannttttttnaagttatttaaatcataatatcatgactgacttttnaattcaaaattaggctgtgactatccttcttcacttaggaagagtgttgtgaaagccagaccatctgctgaggtgctacagttacatgtggccctcagaatgcntttggcctgctctgttttagcactctgttggattaccaatacacaaaacaagttaaccttgatctttcacattaagtatctcagggacaaaatttgacatacgtctaaacctgtgacgtttccatctaaagaaggcagaaataaaacaggactttagattcggttacaataaaatatcagatgcaccagagacacaaggcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagtcttcaggaaaaatactaaaatattttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaanccacaacacaggtctaaactcagcatgctttggtgagtttttctccaaaaggggcatattagcaattagagttgtatgctatataatacatagagcacagagccctttgcccataatatcaactttccctcctatagttaaaaagaaaaaaaaatgaatctatttttctctttggcttcaaaagcattctgacatttggaggagtcagtaaccaatcccaccaaccactccagcaacctgacaagactatgagtagttctccttcatcctatttatgtggtacaggttgtgaagtatctctatataaagggaaattttagaggggttaggatttggacaggggtttagaacattcctctaagctatctagtctgtggagtttgtggcaattaattgccataaaataacatgtttccaaatgcaactaagaaaatactcatagtgagtacgctctatgcatagtatgacttctatttaatgtgaagaattttttgtctctctcctgatcttactaaatccatatttcataaatgaactgagaataattaacaaaattaagcaaatgcacaagcaaaagatgcttgatacacaaaaggaactctggagagaaaactacagcttcagtctgtacagatcaaagaagacagaacatgtcaggggaaggaggaaagatcttgatgcagggtttcttaacctgcagtctatgcacaacactatatttccatgtaatgtttttatttcagccctatttgtattattttgtgcatttaaaaaacacaatcttaaggccg

SEQ ID NO: 384223 - DNA, 3882 bp, Homo sapiens
  misc_feature (253)..(253): n is a, c, g, or t
  misc_feature (471)..(471): n is a, c, g, or t
  misc_feature (494)..(494): n is a, c, g, or t
  misc_feature (605)..(605): n is a, c, g, or t
  misc_feature (845)..(845): n is a, c, g, or t
  misc_feature (1373)..(1374): n is a, c, g, or t
  misc_feature (1381)..(1381): n is a, c, g, or t
  misc_feature (1417)..(1417): n is a, c, g, or t
  misc_feature (1521)..(1521): n is a, c, g, or t
  misc_feature (3091)..(3091): n is a, c, g, or t
ttggttgctggtccacttacaaacacttttcatatttgtatgtctttccaatggttatcctgttttgttcatttcaggcatatggccctgatcagattaactgacatgatgtatatgcaaagccttttgagttcttcagaaaaataaattatcttattcaagactgattgcttataaggaacttattatagctaatatagtaggcacaattttttttgtaattctcctagatgagtcagaacttagttttgangtaggtaaaaattttatggtcacaaatctcaggtgtgagaaaatctctttccttgatactctatataaatagaggatataaatatttcaagtctggaagtagtgagagaagctggtaattctggacatatagtgacagtcaaaaaggagctcaggtacaggactggtctaagctgctcaagattcaggagacagccagtacacagagaagctgagganataataagatatatctaaaacanttatctaaccttctgtggtaacaagctccttaaaggggctggatgatgttgtgttcactttttatcaccagcaaaggctaagataatgtatatagtaaatatttagtaacnatttattaaataaataaatatttaagacagaataaacaagtataataaatgaaccaataagaatgcaccatctaagtcaaaatagccacttttatccttaacattgtacctgctttggctgctgcagaagcaaacttgttggcattagacaaatcaagctggtgatttaataaattccaatgtaagtcttaccagtattgatgaataactatccagcactcaccatgaaagttaaagaancaacacagaaaaagttcctaagtggtcccaatttgaaatgatcagataacctataaaagaacatattcatattatactaacataaacacatataaatgcacttacagcagttacacagtattctcttcaataactagtttccttatgcattaatgtgtaataacagcaactacaatatttagataattataaaaaccaaggcaataatttaaaaactgattaaccgttttactctaacttaagcatggattggatcagtaagattgattaataaatttgaatgcagtcagttggattgattctaatttaaagttttaatttgttgtagaataattttaagtgaatatatttgtccagtgttcgagtgctcaacagtgtgtttgaaaaggaaaacaaagaatgttttgagaatgtgttaattccttaagacaatggattttaattggatctgttgttttcatttttcttcattatcattatacatctgtatgttggacagaacactaacactaaatagtttttagaaannttttttnaagttatttaaatcataatatcatgactgacttttnaattcaaaattaggctgtgactatccttcttcacttaggaagagtgttgtgaaagccagaccatctgctgaggtgctacagttacatgtggccctcagaatgcntttggcctgctctgttttagcactctgttggattaccaatacacaaaacaagttaaccttgatctttcacattaagtatctcagggacaaaatttgacatacgtctaaacctgtgacgtttccatctaaagaaggcagaaataaaacaggactttagattcggttacaataaaatatcagatgcaccagagacacaaggcttgaagctctgtcctgggaaaatatggcaaacagtgcctctcctgaacagaatcaaaatcactgttcagccatcaacaacagcatcccactgatgcagggcaacctccccactctgaccttgtctggaaagatccgagtgacggttactttcttcctttttctgctctctgcgacctttaatgcttctttcttgttgaaacttcagaagtggacacagaagaaagagaaagggaaaaagctctcaagaatgaagctgctcttaaaacatctgaccttagccaacctgttggagactctgattgtcatgccactggatgggatgtggaacattacagtccaatggtatgctggagagttactctgcaaagttctcagttatctaaagcttttctccatgtatgccccagccttcatgatggtggtgatcagcctggaccgctccctggctatcacgaggcccctagctttgaaaagcaacagcaaagtcggacagtccatggttggcctggcctggatcctcagtagtgtctttgcaggaccacagttatacatcttcaggatgattcatctagcagacagctctggacagacaaaagttttctctcaatgtgtaacacactgcagtttttcacaatggtggcatcaagcattttataactttttcaccttcagctgcctcttcatcatccctcttttcatcatgctgatctgcaatgcaaaaatcatcttcaccctgacacgggtccttcatcaggacccccacgaactacaactgaatcagtccaagaacaatataccaagagcacggctgaagactctaaaaatgacggttgcatttgccacttcatttactgtctgctggactccctactatgtcctaggaatttggtattggtttgatcctgaaatgttaaacaggttgtcagacccagtaaatcacttcttctttctctttgcctttttaaacccatgctttgatccacttatctatggatatttttctctgtgattgatagactacacaagaagtcatatgaagaagggtaaggtaatgaatctctccatctgggaatgattaacacaaatgttggagcatgtttacatacaaacaaagtaggatttacacttaagttatcattcttttagaaactcagtcttcagagcctcaattattaaggaaaagtcttcaggaaaaatactaaaatattttctcttcctcataagcttctaaattaatctctgccttttctgacctcatataacacattatgtaggtttcttatcactttctctttgcataataatgtactaatatttaaaataccttcagcctaaggcacaaggatgccaaaaaaacaaaggtgagaanccacaacacaggtctaaactcagcatgctttggtgagtttttctccaaaaggggcatattagcaattagagttgtatgctatataatacatagagcacagagccctttgcccataatatcaactttccctcctatagttaaaaagaaaaaaaaatgaatctatttttctctttggcttcaaaagcattctgacatttggaggagtcagtaaccaatcccaccaaccactccagcaacctgacaagactatgagtagttctccttcatcctatttatgtggtacaggttgtgaagtatctctatataaagggaaattttagaggggttaggatttggacaggggtttagaacattcctctaagctatctagtctgtggagtttgtggcaattaattgccataaaataacatgtttccaaatgcaactaagaaaatactcatagtgagtacgctctatgcatagtatgacttctatttaatgtgaagaattttttgtctctctcctgatcttactaaatccatatttcataaatgaactgagaataattaacaaaattaagcaaatgcacaagcaaaagatgcttgatacacaaaaggaactctggagagaaaactacagcttcagtctgtacagatcaaagaagacagaacatgtcaggggaaggaggaaagatcttgatgcagggtttcttaacctgcagtctatgcacaacactatatttccatgtaatgtttttatttcagccctatttgtattattttgtgcatttaaaaaacacaatcttaaggccg

SEQ ID NO: 384224 - DNA, 1471 bp, Homo sapiens
tcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctca

SEQ ID NO: 384225 - DNA, 2388 bp, Homo sapiens
tcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagagccaccgaagccacctggcagcctggagattgagcagtgaggtgctgcccagcagcccctgagagcctgtggaggggcttgggcctgcacccttccacagctggcctggtttcctcgagaggcacctcccacactcctatggtcacagacttctggcctaggacccctcgccttcaggagaatctacacgcatgtatgcatgcacaaacatgtgtgtacatgtgcttgccatgtgtaggagtctgggcacaagtgtccctgggcctaccttggtcctcctgtcctcttctggctactgcactctccactgggacctgactgtggggtcctagatgccaaaggggttcccctgcggagttcccctgtctgtcccaggccgacccaagggagtgtcagccttgggctctcttctgtcccagggctttctggaggacgcgctggggccgggaccccgggagactcaaagggagaggtctcagtggttagagctgctcagcctggaggtagggggctgtcttggtcactgctgagacccacaggtctaagaggagaggcagagccagtgtgccaccaggctgggcagggacaaccaccaggtgtcaaatgagaaaagctgcctggagtcttgtgttcacccgtgggtgtgtgtgggcacgtgtggatgagcgtgcactccccgtgttcatatgtcagggcacatgtgatgtggtgcgtgtgaatctgtgggcgcccaaggccagcagccatatctggcaagaagctggagccggggtgggtgtgctgttgccttccctctcctcggttcctgatgccttgaggggtgtttcagactggcggctccagtgggccaaagggcaaccacatgagcatgggcaggggctttctccttggatgtgggacccacagcagcttcctgaggctgggggtgggtgggtgggtggtttggccttgaggacgctagggcaggcagcacacctggatgtggacttggactcggacacttctgccctgcaccctggcccgctctctacctctgcccaccgttgtggccctgcagccggagatctgaggtgctctggtctgtgggtcagtcctctttccttgtcccaggatggagctgatccagtaacctcggagacgggaccctgcccagagctgagttgggggtgtggctctgccctggaaagggggtgacctcttgcctcgaggggcccagggaagcctgggtgtcaagtgcctgcaccaggggtgcacaataaagggggttctctctca

SEQ ID NO: 384226 - DNA, 1235 bp, Homo sapiens
tcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgcccggacatatatccagtccctgccccccatgccccagaaggacctgagcagcatcttccgtggagccaaccccctggccatagacctccttggaaggatgctggtgctggacagtgaccagagggtcagtgcagctgaggcactggcccacgcctacttcagccagtaccacgaccccgaggatgagccagaggccgagccatatgatgagagcgttgaggccaaggagcgcacgctggaggagtggaaggagctcacttaccaggaagtcctcagcttcaagcccccagaagctgagttgggggtgtggctctgccctggaaagggggtgacctcttgcctcgaggggcccagggaagcctgggtgtcaagtgcctgcaccaggggtgcacaataaagggggttctctctca

SEQ ID NO: 384227 - DNA, 844 bp, Homo sapiens
gttcgtcgcccggccctgacgccccccgccacctaggtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctggtccgtgggctgcatcatggctgagctgctccagggcaaggccctcttcccgggaagcgactacattgaccagctgaagcgcatcatggaagtggtgggcacacccagccctgaggttctggcaaaaatctcctcggaacacgtgagttggtgcccgccagccagcagctccctctcctggctgagcccccaggctctctgggggagagggtggtgtggaaatgcggggaccatatggggaacatgggatgtggtgggatagagcctagggcaggtgcccaatccctgcaggggaaacaggagaagggggaagacattcctgacaccagggacagtgagtgcaaagccatgaccccagcaagcagtgcctggccagggcagtgggggtgggctgggggcccagcaagcagtgcctggccagggcagtgggggtg

SEQ ID NO: 384228 - DNA, 727 bp, Homo sapiens
tcgggcgcgggcgcggggcgcggggctgggcccgggcggagcggcggctgctccggacatgtcgggccctcgcgccggcttctaccggcaggagctgaacaagaccgtgtgggaggtgccgcagcggctgcaggggctgcgcccggtgggctccggcgcctacggctccgtctgttcggcctacgacgcccggctgcgccagaaggtggcggtgaagaagctgtcgcgccccttccagtcgctgatccacgcgcgcagaacgtaccgggagctgcggctgctcaagcacctgaagcacgagaacgtcatcgggcttctggacgtcttcacgccggccacgtccatcgaggacttcagcgaagtgtacttggtgaccaccctgatgggcgccgacctgaacaacatcgtcaagtgccaggcgctgagcgacgagcacgttcaattcctggtttaccagctgctgcgcgggctgaagtacatccactcggccgggatcatccaccgggacctgaagcccagcaacgtggctgtgaacgaggactgtgagctcaggatcctggatttcgggctggcgcgccaggcggacgaggagatgaccggctatgtggccacgcgctggtaccgggcacctgagatcatgctcaactggatgcattacaaccaaacagtggatatctgtcgtgggctgcatcatgccgagcgtgtccgagcagaccggaccgagctc

SEQ ID NO: 384229 - DNA, 674 bp, Homo sapiens
cagttatgagtaatgagattcaatcagtaattaaaagtctccaatcaaaataaagcctaggacctaatggcatcatagccaaattgtaccagacacttaaagaagaaccaataccagtccttttcaaactcttccagaaagttgaagaggagggaattcttcaaaatttattttatgaggccagcagtaccttgataccaaagccagacaaagatacaacaagagaagaagactacatctcccttcatctgaatggtaagaagaaaaagaagactgcagaccaatctcactgatgaacatggatgcaaaaatcttcaacaaaatactaagaaaccatattccgtagtatattaaaaggatcattcaccatgattaagtgggatttgcccttgggatgtgatggaaatgaataaatgtgagtcaccatgtaacagaataaaggacaaaaatcacatgatcatctaaatagatggagaaaatgcatttgacaaaattcaacatcctttcatgatgaaaactctcaatatattagatatggaaggaatgttcctcaacacaataaaggccatatatgacaagctcatagctaacattgtactcagtggtaagaagttgaaggcttttcctataagacctagaacaagacaaggatgcccgctcttaccacttctgtt

SEQ ID NO: 384230 - DNA, 507 bp, Homo sapiens
aattcttttatcgtcttttagataatttttacatccacaaatcagaaaaggaatgagaatcaaacaaagtaatacatgtggaagaactcagagaacagtgtcattctatagcaacaatcaacacagagcctctgctaagtgtcaggccacattctgagcacagcggagacaggactgagcaaagccaccacagagttcacattataaaaatgaaacaaatgaatgacaagtgtcacacggggtaacaggcacgataggggagacagaatgaggagagcatgtttaacagtaagaggttcgggaaggaagccggcccagacctgagtgaaattagccatgcctgtgcccgggggaagcaggtgccagcaggaggaacaccgagcccagcctcctgaggtggagggcatggggcatggtaacaggctgcacaggagctctgctctggagcacgcgatccgggcacaaccaagagcattggtggcaccacttgaacacttgcagccagct

SEQ ID NO: 384231 - DNA, 422 bp, Homo sapiens
agcccgggacaccgcgggaacacgcccggcctcagcccggaacaccggaagaacacgcccggcctcagcccgggacaccgcgggaacacgcccggcctcagcccgggacacctgcgggaatacgcccagcctcagttttgaaatattgcatcagttcttctgctcctacatcatggagctcttcctcatcaatagatttaattaatttaaatatttatttacaatagcctcttttatcttgacctgttctgcacaaggcagtcctggatactgtgctgagggtttcactccgcgatagccggtgccctacccgagtctctgcacagcggctacatccccgtctcaaaccagtgctctggcgtctgtgtttaccctccctgagcttactgtataaaaaagactgcttttgagagacatcaaga

SEQ ID NO: 384232 - DNA, 321 bp, Homo sapiens
cattggtgagttccgggaaacaaagatatatactatcaatctccacctagtagtcaggaaaacaggtaatttcagtgcatgttaaaggttttttggcttattgcgcctgagccatttgaattgtaagttgcctccagtcacttttagaaataagcatagttcgtaggtacatattgcacatttggatatgttactaaattgcctggacagatctctcttaatcaaactttatataaatgtgctgtgaaataagtgaaacagctattattcctgtattttcactctcctttggtttgaaattccacaggcaaaaagagcatt

SEQ ID NO: 384233 - DNA, 2280 bp, Homo sapiens
tagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgt

SEQ ID NO: 384234 - DNA, 2419 bp, Homo sapiens
tagatggtggcatcacagactttatctacacactttcgggtctgaccactacctcccacaatacctagccattttggaaggggaaaacatgcggtggtctagctgtatagctcagggcttaatttcagcttctgagattgtgatgtcatatttcactctcaaaacataggctgaaagcacgaattactcaaaaagtaagcaaaccaatacctggtgaatctatggacagtcatacacatacatcaggggaaaatgtgtgtgtacaacccaaatttacagtatgattgtcattctttgactttgttttgtatagcctgactctgttgaacatgaaattattagtactctaggttttggacagcttgagttcatttgaattccttccttaggaataagtttttatatacactgctaaatgtgtgatgagaatcataaaacactaaccagctgaggtagctgtgattcactttccccccaccctaacttgagataaaatgaaggactaggcaagtatttcatgttgtgtgagtggacttcggttccttcagtattgtctaggttattgagtctttctttgcctaatagtggattcccactcttaagataacttttattagtgataaatcagtttagggtatattctgtatgacaggcataaaatgttaagggtgaatgctggccttttccaagaaaaggccaccttaacttgtatgaggaaaaaatcctaactattctcttttttgtatctttttttccgtaactgttttgattgtatattttaaagaaaccacttaatttgtgatgcacgtaatatttgtgtgaacctgagaatatgtcacaataggaaaaagcagaaattatacttaggggacatgttaggggggtaaaaatatttaagcctcgaatgttttactgtcatctccactaactatttttacagaaaaagctaaaaactctgttgtaattattgtaagtttacttatttatacttttaaattaggcttttcatacttaaatttttttgacatttgcttttaatatttgtttcttaatgtggaaattgtgtattttaataatcaaattattaggataatagatatatttttaaacattcacctcattaacaaatagatctttgaatttttattaggttttttggctccagacaactgtttagctttaatgatatttctaaattcccagtgacttattaataaaaacaggaaaaatatttaggtaatgtcataaaatttattttacctttctcattttctgagaaaataaatgaaaaaaaccctagatattgctttattaccaacagtgtgtaggtttttgtacatatggaaatttgacacaaaaaaatagggaatttgtatagagaagtttccctcttataaaaggactcccatttgattgttcgaaactataaaatgcacttttactttaccatatctgaaatgacaaaatatcgccctttggaaaacctgactctttgcacgtgtaattcccagagtctacctcagttaaccaggcttagttttaggcaggaatgaattgaattaaattcagttcatcatctatgcagatttgtttcttttaagcacatccttccctcctgctgttgccctcctcccattaacttttctttttaatcttgaaattgtttaaaatattccatctttctttctctagcaaagtgtttgtattccaaataaggcctctgtgaaatgtctgaattacttttcccgtctttgttatggtcagcttcattatttggatgtattgcattcaaagcagcagttccaaacataacacacatctattttcttagagttttgtaaatacaaactaacctgatgacattaaaaattgtggatcctacatgttcctatgttcattctctaaaaacctgagtaactttatgaaaacacacaaacctggaaaaacatcacatttttgtcacatttttactgacaaatgtatattcatatgatggtacggcagcagggagtggcccccagttaacatggctgtgagtggacacagtgtctcgcaggatcactgcatgttatgatggcttgtaagtgcgttgttaagacttttgtttcagtgtttgtctcccagtatttgaacctaatttaaagaaaaagacgtttccaagttgtatttattaaatgtgtttttccttaccttttgtgctgctactttgctaatctcattagcttagctgtgtttgtgcataggttatatttggtaataaatttatagagtgttggttgtcatcgctttctttgtggttcattttgacctatagtcacgggtgcacttcttgccaccagtgggagcaacaaacccctcactagtaagggatggctttccccagatttttgttctcataaaatcacatattataaacctg

SEQ ID NO: 384235 - DNA, 292 bp, Homo sapiens
ttggaacacattcattttgacgaaaataaattaatcatttctatcctaagttggatactggattacctaaatctggctggctataatcattgtgagatggcaattacaacgaaggctttgctgctgctcctctgtaaactgcacataacccttactctaagttccatcaagatttgtgaagttggtagagaaactgcaggcaatgacaagatcctaggtgtaactaggtatttaggaactctgattttcctacatttctcaggccaacaatcgcaaccattgctcaatgcta

SEQ ID NO: 384236 - DNA, 299 bp, Homo sapiens
ctacttcaaagttggaagttatcttaagaggattgtggtcagagaaaacaatttaatatgtgcagctgtggaaaggtttatttctacatcattctttgaagtgacttttcatttagattaaatgtctgttcttctaagttaatttcaatcattttcagtaccaacatttcttgtgcatgtgcaaagccatgctgaactgttggctccattaacaatagaagaactttgcaaacagttaaataattccaattgtatatcaaagtcatcagatgtttcaaatagaaaattgatcaagctca

SEQ ID NO: 384237 - DNA, 1721 bp, Homo sapiens
gcaggctcagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggacgtgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcctagaccccagattcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctggtgagggcaggaatcagagtctttctggcccaatttctacctacattcctcaccctaattccacttgccaaatcctctcactccttccttccacccattctcagctttggatgcacagagacattcattcctcctctcaactctgctcctataggcaagtagtgactaaaatcctcgtgaagcaaggtggggaggttgattaataatttaacttgggactgggcatggtgactcacacctgtaatcccagcactttgggaggctgaggtgggtggatcgcctgaggtcaggagttcgagaccagcctgaccaatatggtgaaaccctgtctctacttaaaatacaaaaattagctgggtg

SEQ ID NO: 384238 - DNA, 1837 bp, Homo sapiens
gcaggctcagcgcatcccagccagtgtctcctgcagctcagcagctgccttcaccatggacagcataagcacagccatcttactcctgctcctggctctcgtctgtctgctcctgaccctaagctcaagagataagggaaagctgcctccgggacccagacccctctcaatcctgggaaacctgctgctgctttgctcccaagacatgctgacttctctcactaagctgagcaaggagtatggctccatgtacacagtgcacctgggacccaggcgggtggtggtcctcagcgggtaccaagctgtgaaggaggccctggtggaccagggagaggagtttagtggccgcggtgactaccctgcctttttcaactttaccaagggcaatggcatcgccttctccagtggggatcgatggaaggtcctgagacagttctctatccagattctacggaatttcgggatggggaagagaagcattgaggagcgaatcctagaggagggcagcttcctgctggcggacgtgcggaaaactgaaggcgagccctttgaccccacgtttgtgctgagtcgctcagtgtccaacattatctgttccgtgctcttcggcagccgcttcgactatgatgatgagcgtctgctcaccattatccgccttatcaatgacaacttccaaatcatgagcagcccctggggcgagttgtacgacatcctagaccccagattcccgagcctcctggactgggtgcctgggccgcaccaacgcatcttccagaacttcaagtgcctgagagacctcatcgcccacagcgtccacgaccaccaggcctcgctagaccccagatctccccgggacttcatccagtgcttcctcaccaagatggcagaggagaaggaggacccactgagccacttccacatggataccctgctgatgaccacacataacctgctctttggcggcaccaagacggtgagcaccacgctgcaccacgccttcctggcactcatgaagtacccaaaagttcaagcccgcgtgcaggaggagatcgacctcgtggtgggacgcgcgcggctgccggcgctgaaggaccgcgcggccatgccttacacagacgcggtgatccacgaggtgcagcgctttgcagacatcatccccatgaacttgccgcaccgcgtcactagggacacggcctttcgcggcttcctgatacccaagggcaccgatgtcatcaccctccttaacaccgtccactacgaccccagccagttcctgacgccccaggagttcaaccccgagcattttttggatgccaatcagtccttcaagaagagtccagccttcatgcccttctcagctgggcgccgtctgtgcctgggagagctgctggcgcgcatggagctctttctgtacctcaccgccatcctgcagagcttttcgctgcagccgctgggtgcgcccgaggacatcgacctgaccccactcagctcaggtcttggcaatttgccgcggcctttccagctgtgcctgcgcccgcgctaacgccccggcccttccagattcgcctgtgagcgatgaggcccacccatgtgggttgctacgtccccttcttggtccacagtctgccctcatccctctggcagtcacgctgtcttccctgcatgctgtgcctgccgcgtgcccttcccccatccctccaatctgtgccccgtctgcagggcagaggcagatgtggcatgtctttttgtacccacagagcttgttctatggcacgcccttttctaggctttttgtatcatttcttagtacattgtaatagattcaaaccagtcttgg

SEQ ID NO: 384239 - DNA, 231 bp, Homo sapiens
gcttcctaaggacaactgctccctcagtctggcagcaccaaggacaaggaccactcccctttgcctaagtaccttgagaggaagacaggccaaggtccctccgcggtaccattctgcacatgttccacagtcctcccgccacctccctgtcacccatccctggaacctagctgtactttgaaaatatagcaactggagaaataaaaaggaaaaacatggccgggcgcagtg

SEQ ID NO: 384240 - DNA, 360 bp, Homo sapiens
actaagtgttaataattatctgtgtgtggtaaaatcaagaatgaccttagtggccttaatatttaattttccacagtcacaaaaaaagaaacttacttaaaattgaaaacaactttgctaaagaatataatataggtacgtcacgtaaggccttcttttagaaaagccatgaaatgacctataacattgtcctatttataacacttacctcataaccaaaaatcattttaactttgaagactttatttcctcctttacaattaaatattcaaaaggtttagtcttaatttttaaaaagcaagttttccagcatactccacataaaaactgtgaacgtataagcatttgggtttttcgagg

SEQ ID NO: 384241 - DNA, 271 bp, Homo sapiens
aaatgtcgtggtttgggaaacaacacccgaagactcgaaaacaaaagaattgctatttggtagagggtgtggggctcaacaaacaacccttaatgctgctgatgttctgaaataagtaatatgacatagtagcaagtaggagacaaaatatcacctttcttactgaaaagtaggagacaaaagcttaaagtgttggaaaagaatacttgcagtaaaaaccaaatgggctagatgacttagcccaagaattagatggaattacctgctctgt

SEQ ID NO: 384242 - DNA, 301 bp, Homo sapiens
ccatatacagcactctgtttttgagttatttatgatacagtttctacttatttgagccttttttaatgttaacataagttttattcttttccataaggtcttactcttttttgtatgtttattctgatgtatttttaaacttctttgatattgtaaatggtgtcctttaaaattttgcattttctaactgtgtgctagaatgcagaaatgcagttgatttcatatattgattttgggactgacttaaactctgactattctaatgatttagcaataaattctagataacattatatatgaa

SEQ ID NO: 384243 - DNA, 428 bp, Homo sapiens
agtagggatgtgtgtttagatgcaggttctccccctcgcacactctgggaacttttaatttttcacctatctcatggagtaggcctgctgcttctttcaaaggctctgtgaattctttcagttttcctgacaagttcctgtggtaattcatggaaaaaaaattaacagtatgaatctccacccactattctgtcctttcaagtgggagaaggacactaacactacctcctatccactatcttgaaaaaaaacagaatgggtttttttaatgatccaagaatatgctgtctacaagaaagtcatcttatccataaagacacacatagactgataaaagtaaaggtatggaaaaagatattccacacaaacagaaaccaaaagtgaacagaagtagctatacttatatcaaataaaacaagttataaata

SEQ ID NO: 384244 - DNA, 504 bp, Homo sapiens
  misc_feature (16)..(16): n is a, c, g, or t
tcacgctcgcccgatncactggttgatacacagtacaccaccccaacaacaaaaacacacaaaaacagacaaggaataaatttcagtaaaaacttcctaataattaaaaccctcctacagtgtgagagtattcagacaggtttgtcagggacagtggggaggcagtttgtgtatcagaatccgtatgtggaatcccaagttcggttgcctgctgctcaacacgtgatgctgcagcaactcttggaccttgttcagaagggatttgaatagcctgttctctctaggggtcctcatgctgcagctgtgcccatggctccccaagcctggctctaactgtgttgttttgagcagggttaataagcacgaactcgtctacacattgtagtgtgtataattcctgagctccaccaccacaccttgaattatcaggaactgaccttttacttcctgtggacctagtgatgccgtcgcatgagtaggccctttccttgggctattaaaatc

SEQ ID NO: 384245 - DNA, 1762 bp, Homo sapiens
  misc_feature (168)..(168): n is a, c, g, or t
aggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccggcaagnctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccattctgtgcagtaagcctgttggataaagaccttccagctcctgtgttctagacctctgggggataagggagtccagggtggatgatctcaatctcccgtgggcatctcaagccccaaatggttgggggaggggcctagacaaggctccaggccccacctcctcctccatacgttcagaggtgcagctggaggctgctgtggggaccacactgatcctggagaaaagggatggagctgaaaaagatggaatgcttgcagagcatgacctgaggagggaggaacgtggtcaactcacacctgcctcttcctgcagcctcacctctacctgcccccatcataagggcactgagcccttcccaggctggatactaagcacaaagcccatagcactgggctctgatggctgctccactgggttacagaatcacagccctcatgatcattctcagtgagggctctggattgagagggaggccctgggaggagagaagggggcagagtcttccctaccaggtttctacacccccgccaggctgcccatcagggcccagggagcccccagaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaaacatcc

SEQ ID NO: 384246 - DNA, 1236 bp, Homo sapiens
  misc_feature (168)..(168): n is a, c, g, or t
aggtgagcggttgctcgtcgtcggggcggccggcagcggcggctccagggcccagcatgcgcgggggaccccgcggccaccatgtatgtgggctatgtgctggacaaggattcgcccgtgtaccccggcccagccaggccagccagcctcggcctgggcccggcaagnctacggccccccggccccgcccccggcgcccccgcagtaccccgacttctccagctactctcacgtggagccggcccccgcgcccccgacggcctggggggcgcccttccctgcgcccaaggacgactgggccgccgcctacggcccgggccccgcggcccctgccgccagcccagcttcgctggcattcgggccccctccagactttagcccggtgccggcgccccctgggcccggcccgggcctcctggcgcagcccctcgggggcccgggcacaccgtcctcgcccggagcgcagaggccgacgccctacgagtggatgcggcgcagcgtggcggccggaggcggcggtggcagcggtaagactcggaccaaggacaagtaccgcgtggtctacaccgaccaccaacgcctggagctggagaaggagtttcattacagccgttacatcacaatccggcggaaatcagagctggctgccaatctggggctcactgaacggcaggtgaagatctggttccaaaaccggcgggcaaaggagcgcaaagtgaacaagaagaaacagcagcagcaacagcccccacagccgccgatggcccacgacatcacggccaccccagccgggccatccctggggggcctgtgtcccagcaacaccagcctcctggccacctcctctccaatgcctgtgaaagaggagtttctgccatagccccatgcccagcctgtgcgccgggggacctggggactcgggtgctgggagtgtggctcctgtgggcccaggaggtctggtccgagtctcagccctgaccttctgggacatggtggacagtcacctatccaccctctgcatccccttggcccattctgtgcagtaagcctgttggataaagaccttccaaggactttattcggaccaagcagagctcacagctggacaggtgttgtatatagagtggaatctcttggatgcagcttcaagaataaatttttcttctcttttcaaaaatgtataaaaatcattatacatagcattaaagaaacatttttgagaagtacaaaacatcc

SEQ ID NO: 384247 - DNA, 447 bp, Homo sapiens
tctgcaacagtactctctcctaattttttgggcactccaattcagtttcctttgatgagttctctcattcttctagtagctcgggcagaagccctgaagtcatccctggcttctttctttctcttatggacaatgttcaattcatcagaacccctgtttttttctcccttaaaaatacatctagaataagaacaattttaccagcactgctgctagctacttccttggtccagacaccatcctctctggcctggagggttacacttgcctcctgcctggtctcctggatcccccttcttgtgcccataagctgttctcaacacacagccaaagtggtccacttgaagcccaagtcggctctccgaacatctcctcagagccctcccctggcttctcatctcactcagaatagaagtcaaagtcagatttaaaacttaaaaaaaaaaa

SEQ ID NO: 384248 - DNA, 182 bp, Homo sapiens
ccgcagcatccaccagaactacaggggcgtcctggcatgttgcagagaggctgatttaaggctggggtccatccctgtttttccctagttagaacctgaccctcctcctcaaggacagggtcctgacaagctctgagatcctgatgagctgatcacagtgtctcccagctcctccgtatttc

SEQ ID NO: 384249 - DNA, 3041 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcagattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattggaaaaag

SEQ ID NO: 384250 - DNA, 2448 bp, Homo sapiens
gagagctgtgcagtgattagacaggaaccccgaaaccaaagactcttaaaagctgaagagaaatcagactttgaagaactgtggcgtccaagcatgctgaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattggaaaaag

SEQ ID NO: 384251 - DNA, 1188 bp, Homo sapiens
gggcggacggattacagcgagggaaagggggttatatagtgatttccgtgttgtgaaaggcagaaccgacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattggaaaaag

SEQ ID NO: 384252 - DNA, 2796 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagattttattgcagccaggaattatccctgacggacactgtgtgtgaggagtctagcagaccatgatcgttcctggctcttgtttccagaagcactggagaggactgtgtgaatttgaagtgtgtgaaattaaactcatagatgcctcagtagttaatgaagaataagtaagcctcactgttcaactttagttatttttgccccttctcctggttttttacatcccaaccacccccagttttgcctttcacgtctatttgacatagcaaccactctattgctgggtaatttatgttctgtttaaaacagaaatatttgtgcctgtagtctaccattgctcaatttgtaatttagctttgcaatgaaagcttctaacagtt

SEQ ID NO: 384253 - DNA, 1431 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatataggtgagtaaaataataacagttggggtaggagggaggctgaagagtggggagacaagatagcttcacataatatttaaaagaaatagtatttcttaaccaaaggagatgggtattttgaattgtgcaagtatgtatagacttgttgatattttctctgaaatgcagaaaaataaattgtaccagaggatgtcatgatgcacagtattctctcttaacttcagcgtgtgtattggtctagaaaacgttcatccttcaagggttgttttgaatagtggcattgtaagctattggggtgtagacgctgctgctactttcttagacagtaactaaggtaaatttcctatgatctctttgaagagtcctagaatgaagggatggaaaagttgtgattataatgtacatctgctgagaatgagaagttgtaactagaacttggcttcctgacgccatgcattgccctgatgattagagccattgtgacttttggcttaaaaaaaa

SEQ ID NO: 384254 - DNA, 3200 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttgctttttacgcacattgtgatagagcatcttttgttgactcacgtaacctccatgtgtgggtcctttgttttattagaaccatggaagaaggttcctgggccatcagtatgtgttgcagagctcacagccaggaacacttattttgaacaatgcagacagtacttgccagagtcccaaatgctgaattattgaaccatgtttttttttcctttgttgaaaaaaataaaccagggtgatttctataaatcaccagtttttggcattggaaaaag

SEQ ID NO: 384255 - DNA, 3183 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaagcagtttaatactaaaacgaaggatgggttcaccgtgaacacaaaagttcccagccttaaagaccaagggaaggaatatgatggattcacaatcacgattacaggagacaaagttggcaatatattattttctgtggaaactcaaaccacggaagaaaggacacaattatatcatgctgaaatagatgcactttataaagatttgacagcaaaaggaaaagtattgattctttcatcagaatttggggaggctgatgctgtctgcaacttaatcttatccttagtttattacttttataatttaatgccactctctcgaggatccagtgtaattgcttactcggtcatcgtgggagcactgatggcaagtggaaaagaagtagcaggaaaaattcccaaagggaagttagtcgactttgaagctatgacagcccctggttcagaggcctttagcaaagtcgccaaaagctggatgaacttgaaaagtatttcaccttcttataagactcttccatcagtttcagaaacgtttccaacgttaagatcgatgattgaggtgctaaacacagactcttctccacgttgtcttaagaaactctagttctgctgctgtatttatacaagtaaagggccggacctcttgcttcttaagttattttttaaaacatggaattataaagaaattaggtcctctattacttttgataccaatttttataggaattgaatacttgaaatcattttctttacttttctgaaccataatgaaaatcatgaaagaggctttcggggggaaaaagctacttgacttggagggaaagcgtatgtattagccggcagcctgttggttcccacttataaagtcatataactccttccttacagtaaaaaaaattttcctcaacaactaaaatataatactgaagatgaacaaaaacaaaaccaaataggagtgtttgtattcctttagagatctggatatttttcaaagacttcacccctcccacccctcaattggcgtgcccgggtcaccagcagcagcagcggcgttccgtcgctcccaagatttgggtgaaggggagaacgttccttgttatccctacccccccggggccctcaagcttattttcttgttgaagaaacacaaaaccctcgagattcatgttctgtatgttggagaaaaaaaaattatttaatgttcccccaaaaaagacagtatattttgtgctttgtaaagtgttaattaaaatg

SEQ ID NO: 384256 - DNA, 2145 bp, Homo sapiens
  misc_feature (16)..(16): n is a, c, g, or t
  misc_feature (100)..(100): n is a, c, g, or t
  misc_feature (180)..(180): n is a, c, g, or t
  misc_feature (253)..(253): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (277)..(277): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (340)..(340): n is a, c, g, or t
  misc_feature (345)..(345): n is a, c, g, or t
  misc_feature (348)..(348): n is a, c, g, or t
  misc_feature (367)..(367): n is a, c, g, or t
  misc_feature (373)..(373): n is a, c, g, or t
gtggccgccgcgggcnccgcccggcgtgtcctgctgctgctgctgctgggggtcctgtccgccgggctgcggccaggcgccctggccaccgagcactacncgccgctctccctgctcaagcaggagctgcagcaccggcagcagcaggaggccccggcgggcggcggcggctgcagcccncagtccggggactggggggaccagtactctgccgagtgcggcgagtcatcctttttgaacttccatgactcanactgcgaacccaanggancaanancctgtgactccttgctttccctcaanactganaanattctgagccaggccaagtctattgcanaacanaanaaattcccgtttgccactnataatnacaacacaaatgaagagttagctattgcttatgtcttgattggcagtggtctgtatgatgaagcaatacggcatttttcaacaatgcttcaggaggagcctgatctggttagtgcaatttatggccgagggatagcctatggaaagaagggactacatgacattaagaatgctgagcttgctctgttcgaactgagccgagtaattaccttggaaccagatcgtccagaggtatttgagcagcgagcagaaattctgtccctctgggacgaattaatgaagcagtgaatgacctcactaaagctatccaactgcagccctcagcacggctgtacagacatcggggaaccctgtacttcatatcagaggactatgcaacagcccatgagactttcagcagtccttagaactgaacaaaaaccagcctatagctatgctatacaaaggtttaactttctttcacagaggacttctgaaggaagctattgaatccttcaaagaagctttgaagcagaaagttgactttattgatgcatataaaagtctagggcaggcatatagagaactgggcaattttgaagcagccactgagagctttcaaaaggcactgttgctcaaccaaaatcatgtgcaaaccctccagctccggggaatgatgctctaccaccacggcagcttacaggaagcccttaagaactttaagcggtgtctgcagctagagccatataatgaagtgtgccagtatatgaaagggctcagccatgttgccatgggacagttttatgaagggataaaagcacaaacaaaagttatgctgaatgatcctctcccaggccagaaggctagccctgagtatcttaaagtaaagtatctccgagagtattctcgatatcttcatgcacaccttgataccccccttacggaatataacattgatgtggatctgcctggaagctttaaggaccactgggctaaaaatttgcctttcctcatagaagactacgaagagcagccagggttgcaaccccacataaaagatgtgttacatcagaattttgagagttataagcctgaagtacaggagctgatttgtgtggctgatcgtttgggatccctgatgcaatatgaaacacctggtttcctgccaaacaagagaatacacagagctatgggtttggccgcattggaggtcatgcaagccgtgcagcgtacatggaccaactcgaaagttcgaatgaatgggaagacacggttgatgcagtggagagacatgtttgacattgcagttaaatggagaaggattgctgacccagaccagcccgtgctgtggttagatcaaatgccagcacgaagtcttagcagaggttttaacaaccacattaatttaatcaggggtcaggtgatcaacatgagatacctagaatattttgagaaaatacttcattttattaaagacagaattcttgtttatcatggagctaataatcctaaaggattgctggaagttcgggaagccctggaaaaggtacacaaagtagaagaccttcttccgattatgaaggtaactttagcatcagaatggcagtccatgtttttagaggaaaagaaaaccaacagcacttttttaaaaagaactcagaattattaaatgctatttgaaatcactcgtatgaacacattctgaataataaccaaaataaaagaacctacaggcatcagactcaaacagaaaaaacaacttgtgaggaagcagttaatatagaaaaaagaaaa

SEQ ID NO: 384257 - DNA, 3623 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384258 - DNA, 3960 bp, Homo sapiens
  misc_feature (3956)..(3956): n is a, c, g, or t
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctatttaaaattgtgtcaactttctgctttcagggcatttatggctcttctgttgaaatatattgatctttccaaatattttcatttgctttctaaaaacccagaacatgagccactactggactttgccttgtgtttgaagtgtatggcataaacccaaggtttttattagtcatctatgctgtgattaattcattttgttcttttaacaaaatatttccatccacttcacattgcttcaatctttaacagaaaagcaatataaaggttatagaataaaatgtggttttgggccaaagaccaatccaccacatgcgcaccaactccacgcacaaagcgngcgg

SEQ ID NO: 384259 - DNA, 3986 bp, Homo sapiens
gaactcctgacctcaggtgatccacccaccttggcctcccaaagtactgcgattgcaggcatgagccaccatgcctggcctgaggaatatttttctaggttccccccaccccaagcatttattctgcaattttagttttgttcctaaagcaagcaaggtttaaggatttaaaaataatccgtattttagaatgctttctggctttgttactttttatccacagtagaagttctcagagaatgatctccctcttttaatttaactttttggcacagtattttgagaattataaataatattagaatgttttctggctgggtgtggtggctcatgcctgtaatcctggctacttgggaggctgaggcaggagaatcacttgaacatgggaggcagaggttgcagtgagccgaggtcatgccactgcactccagcctgggtgacagagcaagactctgtctgggaaaaaaaaaaaaaaaaaaaagagtgttttctttcctattttccaccacttgattaagttacttttcctcttaagtattttttgctgagtatgctgacttaagagtaatgttacaaaatttaatttttaaagttctctgaaagcccctttatgagagttttaggctatcaaattgtgtttaattcttaacaattttttgaaaaattatagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384260 - DNA, 1971 bp, Homo sapiens
ccatccggcgcccaggctgtgatttccagtgtcaatgagacctccctcatgctggagtggacccctcccagcgacttgatataagtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384261 - DNA, 2938 bp, Homo sapiens
  misc_feature (898)..(900): n is a, c, g, or t
  misc_feature (1007)..(1008): n is a, c, g, or t
  misc_feature (1191)..(1191): n is a, c, g, or t
  misc_feature (1193)..(1193): n is a, c, g, or t
tttataagcagtttacaactacttggcatcactagctcagaagctcaaaatgtatatacaaagaaatgattagaatttatcttaactgaaagcactagtttaaacagcctagagtcttgtagaaattgttatccaaaacatgcagaggcagcaagagttgcccaaaaccacattatctatactttatatgcttttctgttaaagattgaagcaatgtgaagtggatggaaatatttgcttaaaagaacaaaatgaattaacacagcatagatgactaataaaaaccttgggtttatgccatacacttcaaactcaaggcaaagtccagtagtggctcatgttctgggtttttagaaagcaaatgaaaatatttggaaagatcaatatatttcaacagaagagccataaatgccctgaaagcagaaagttgacacaattttaaatagaattattgaattaaacaggaccttgcctcaagaaataatctaccaacaattaacttgttttaaagcaaagttaggaagtgagcatgttcaaattattaaataaaaaagtaagctgtgtatttcattcatagaaatagaggctggcctacttcggatgattctcagcatgtgattacagatgtgggcttatacatcctagggagttaaggcgtactctggcttggatagagtagagctctttgaaactcttctctcacccagctagtttatatagactagagaactagaatgtagcagcatactctgtcttagaagcccttttatatggagctggtctggaaggtttgaaaacataacaaatgtgttggtgtctcccaatgtattgctagattcttacccaagagcattatcctggttagggtttggtttggttttgttttgtttttaatgtnnnccacaaactaacactagatgttagttctttcatcaagtgaggagagtagaagaaaagtccagaactctgaaacaccttttcaaaagtttttcaagccatgatgtttnnaagttaaatgctctgttatgtaagcaatataatcagtttttattaatgtaacattccttagtgttttggggtatcacacaaaaaagaatatccatatctggaagcaacagcttttaaataagagcattgtggtggtggtggtgatagtggtttttttttttttttttgagttggagtctcgcncngttgcccaggttggagtgcagtggcacgatctcagctcgcttcaacctctgctcccaggttcaagcaattcttctgcctcagcctcctgagtagctgggattataggcacctgctaccatgcctggctgatttttattattttagtagagacaggtttcaccatgttggccaggctggtcttgaactcttaacctcaggtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgagtctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384262 - DNA, 2098 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgagcccggagactagcttgtagactgctaatatagtcacataa

SEQ ID NO: 384263 - DNA, 1878 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcataggtaagcagtgcttgaaactatggcaaaaaaaaaaagtgacaaaaaatgcacagaactgacaattttcgttatggactaagataattttttcttaacatggaatttagcagttcccttcctaattggttttctgagtatttttaatatcggataatagctcactttaaaagttcctcggctgcattcggtgcgggggtcttggcctgggccaggtgggctgcagtgtagcgggtgctcaggcctgcccgctgctgagcagccgggccggcgggcggctacgctaaccggcacagaccaccggatggactggccggcagccccgcaccagtgcacgaagtgggcgggacagaaacttctggggttggaagtccagtgaggctaaaagccggtaccaaagtctctaggcatcagggctgcagcccaagagtctcacgaccagtgggcaactggatggccagacaggtgtctcagtggtggcctctccgtctcagggcttcatcccacttctcagtgggcctgacgtccctgggcaccctggatgtctacctgcattagccagagccatcacatggcctgtgacttgcctttttttgccagttgattgtgccacacacagtgtcatttctgtgtcatttggcacagctggaggtgcaaggaggagggcagcctcatgtccagtcccagtttcacgtaactttattcttctgaataaagacaatttgctaacctta

SEQ ID NO: 384264 - DNA, 283 bp, Homo sapiens
ttcactaaaagtttgcatccagctgtgtaggtagtgtttgtttcttgttaacttttttttcgtctaaaagaatactttaaaacttttcaatctcaaatgactgtaacttgctgacaggtgttaacagaagaagtagatctttttgttttttgcttatgacctgtattttaatatttgagcttatagattagagattgtgagagaaatctgtttatagtcttattttcccttgtgtattttttcttcctagtacatggaaaaagaggatgcagtgaatatctta

SEQ ID NO: 384265 - DNA, 443 bp, Homo sapiens
gattgttagtttctttgcctcagttgtagtctgatccttacagcttttaaacaacagtagagttcaccgtcaagaactaaggatggttggcaggcagatagaaaggtagcaagttgacccaactatctctggggaagtgggaacaaagaaaggttacatcagcactgtcatcacatagctctatagttctaggcctgcaggctcaatcaagtagccttgtataagattctctggaggaggtgctgaaagttgcttatacttgctatggaatttgattttacttcggatatctttttaccataggtacttctccctccaagccacacatcctcttggatttgatgatgttgtacgattagaaattgaatccaatatctgcagggaaggtgggccactccccaactgtttcacaactccattacgtcaggcctggacaaccatgg

SEQ ID NO: 384266 - DNA, 406 bp, Homo sapiens
atcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagt

SEQ ID NO: 384267 - DNA, 304 bp, Homo sapiens
gtgaatcacccacctcggcctcccaaagtgctggaattacaggcatgaaccaccatggccagccaaataagagcatttttaatgtaaaattatgcatgaaatgtacattcaattttgtctttgtttactaggatccatgttctcacaagctatgaagaaatgggtgcaaggaaatactgatgaggtaaatcctacctttaggataaaaagatttctgtttataagtgccaccctcatgtaagtgaggtttaaaattttccttttctttaggtcccatgtttaagcagcatggcacatttatgtt

SEQ ID NO: 384268 - DNA, 697 bp, Homo sapiens
cagtgctgtgactacaggagggagtcagtgaatgtctgcatgtgtgtctttaccatccctcttgaatatgctctagggttaattcctagaagtagaattactctattgaaaattggcaatatttttcattctaatatctattgccaacatgggaaagcaagtctggatgccagtccttgttatatgccccttgggtaagttacgtaacctctttaagcttctgttcactcatattttaacaaggaaaattacaatattttacctcacaaaattgtagtcagcttctggctgtcttaaactctggtatatagtaaacactaagtgttggtgtccatccttaatttgtaataataggtcacttgttagagaaatgcaccttaccattttcttttcttttcttttttcagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccattt

SEQ ID NO: 384269 - DNA, 3569 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaagattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384270 - DNA, 3513 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcaggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcagcaggctcagtatgatcaaccgttagagaaatctacaaagttatgactcaaaacttgagataaaggaaatctgcttgtgaaaaataagagaacttttttcccttggttggattcttcaacacagccaatgaaaacagcactatatttctgatctgtcactgttgtttccaggagagaatgggagacaatcctagacttccaccataatgcagttacctgtaggcataattgatgcacatgatgttcacacagtgagagtcttaaagatacaaaatggtattgtttacattactagaaaattattagttttccaatggcaataacccatttatgagagtgttttagcctactggaatagacagggaccacatcctctgggaagcagataagcatagaactgatacttgatgcacactcgtagtggtaactcatccctaatcagcattgtaaagcaggtgccagaggtggtttgctttgtccttccaaagcaggtgagtcagccccaccgagagccaggcagctttgagtggcagcgtggtgctagcagcttcagcggaacagggtgagagttaattatgcagtcttcttgacagcggcattaatttggaaggaaactgacaagtcatgggtcaagtttcagtgacttcctccttcctctgatggcagtatatagttttcacattttaattcctcctcctgagatgcactatacttaaaaccattctctcccctgctaacagaagggtgtgaatctggtttactttgagcattaggatttgcccctttggaattctgcactccagttacttaactttcccttcagaatacatgtggaaagaaagaaagaaatagcgatgactccacttttgcccctgtggcaccttgaacaaagcagttcttcccaaattatactttttttttttttaaataaggtgagcaggatgactggggagagagaaacatttgactttgactgcctcccccattctttgctgtgagctggaaagtgtgcagttggtcgtctttcttctcctttctttaggatagtaagagactcactcactgcacttctgctcagttggcttctgcatcgggatcacacagccatcagcaggactgcccagttggtgagcacactccattgaccacgtggcgccagcgcttcctcaatgcacatgattgagaggaaagaaagttctcttagatgttactgcttttgctcagactttgcaaaaaaaaatatatatatatatatgtataaatatataattattaatcacttttgtccttgagaaagtcttgaatgaacagagaatttattccattgcaatatttgattgtatagaggcacactgtttcatcgacagaagaagcaaaaaggctttgtgtaagtttttggtactatgtaccacctctgttattcttttaaagctgaagtattcatgtacttaaaccatattatatttaattgtgtttgattttaaaatatatatatatgaattctattta

SEQ ID NO: 384271 - DNA, 2173 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtctttttgcctggctttctgtccagcaatctttattataaatatttgaatgatctcatccattcggttcgaggagatgaatttctgggcgggaacgtgtcgctgactgctcctggctctgttggccctcctgatgagtctcacccagggagttctgacagctctgcgtctcagtccagtgtgaaaaaagccagtattaaaatactgaaaaattttgatgaagcgataattgtggatgcggcaagtctggatccagaatctttatatcaacggacatatgccgggaagatgacatttggaagagtcagtgacttggggcaattcatccgagaatctgagcctgaacctgatgtaaggaaatcaaaaggatccatgttctcacaagctatgaagaaatgggtgcaaggaaatactgatgaggcccaggaagagctagcttggaagattgctaaaatgatagtcagtgacattatgcatcaagtatcagttctatgcttatctgcttcccagaggatgtggtccctgtctattccag

SEQ ID NO: 384272 - DNA, 1929 bp, Homo sapiens
gcctagcgcggggaaggaccggaactccgggcgggcggcttgttgataatatggcggctggagctgcctgggcatcccgaggaggcggtggggcccactcccggaagaagggtcccttttcgcgctagtgcagcggcccctctggacccggaagtccgggccggttgctgaatgaggggagccgggccctccccgcgccagtccccccgcaccctccgtcccgacccgggccccgccatgtccttcttccggcggaaagtgaaaggcaaagaacaagagaagacctcagatgtgaagtccattaaagcttcaatatccgtacattccccacaaaaaagcactaaaaatcatgccttgctggaggctgcaggaccaagtcatgttgcaatcaatgccatttctgccaacatggactccttttcaagtagcaggacagccacacttaagaagcagccaagccacatggaggccgctcattttggtgacctgggcagatcttgtctggactaccagactcaagagaccaaatcaagcctttctaagacccttgaacaagtcttgcacgacactattgtcctcccttacttcattcaattcatggaacttcggcgaatggagcatttggtgaaattttggttagaggctgaaagttttcattcaacaacttggtcgcgaataagagcacacagtctaaacacagtgaagcagagctcactggctgagcctgtctctccatctaaaaagcatgaaactacagcgtcttttttaactgattctcttgataagagattggaggattctggctcagcacagttgtttatgactcattcagaaggaattgacctgaataatagaactaacagcactcagaatcacttgctgctttcccaggaatgtgacagtgcccattctctccgtcttgaaatggccagagcaggaactcaccaagtttccatggaaacccaagaatcttcctctacacttacagtagccagtagaaatagtcccgcttctccactaaaagaattgtcaggaaaactaatgaaaagtatagaacaagatgcagtgaatacttttaccaaatatatatctccagatgctgctaaaccaataccaattacagaagcaatgagaaatgacatcatagcaaggatttgtggagaagatggacaggtggatcccaactgtttcgttttggcacagtccatagtctttagtgcaatggagcaagagcactttagtgagtttctgcgaagtcaccatttctgtaaataccagattgaagtgctgaccagtggaactgtttacctggctgacattctcttctgtgagtcagccctcttttatttctctgagtacatggaaaaagaggatgcagtgaatatcttacaattctggttggcagcagataacttccagtctcagcttgctgccaaaaaggggcaatatgatggacaggaggcacagaatgatgccatgattttatatgacaagtacttctccctccaagccacacatcctcttggatttgatgatgttgtacgattagaaattgaatccaatatctgcagggaaggtgggccactccccaactgtttcacaactccattacgtcaggcctggacaaccatggagaaggtaacccagaacttcaaacgtatcaaactacaagaagttttattggtagaactcataaaatataaggtgggaaaaccaagcagaatagcacagtggaaattgaagcagtccagcaaagtgattaagagcagaggccttgagtctggcctggtatgtacagtcacgtgccacataacattttagtcaacagtggactgcgtgtacgatggtcctgtacgattataatggatcaaagctggtagtgcaataataacaaaagttagaaaaaataaattttaataagtaaaaaag

SEQ ID NO: 384273 - DNA, 474 bp, Homo sapiens
ctccatgttggtcaggctggtcttgaactctggacctcaggtgatccgcccacctcggcgtcccaaagtgctgggattacaggcgtgagccaccgtgcccagccttaattaaaaactttcttaacagcaaaagtcacttttcccaaatatgtcaaagtcttctagattctgatcttgcttctagatcatcttagttcatcctgtagtttagtgattctcagtgaatccttacatcagaatctctgggttacttgttaaaaaatgcttgcacccttctccaaacatttaattaaattttagggagcaggtccaagaattgcatttaaacaagtacctcagatatgtggtgtgcagaataaagcttgagtacctagatctggaagcagcatagttattaatgttaaaattaaaaatcattgatctgtctactttggcagaatgtaaacgtcaggtttacagggaccatgtgtgtct

SEQ ID NO: 384274 - DNA, 875 bp, Homo sapiens
tgtagagacagggtctcactatgttgcccaggctggtctcaaactcctggactcaagagagccacccgccctggcctcccaaagtgctgggattacaggagtgagccactgtgcctggccctaaaaataatttattaagcacataaagcactctatgccagacacggttcaaagaacttcatgttaactcatttaatcctcccagttgtagctataaaggagatgctagtataaaaagttcaagaaactgaggcaaagagcaatttagtaacttttggggatttgaatccaggtagcctttctaataccaagggaataaaacaaaataaattacatgcagtttaaagcagtggcacttctgtcatgtttatctcttcatttcctagagccaaatctttcccaggacttacataagtaatgtccattccttgtcctgtttaaagatagtaccatctagcctcaaagaactgattatagaattgggtctgtaatttgtttctggaaattggtgttctgaaactatttccccaacaaaacacctagaaatgctgaataaaatataagaaaaatcttttaatgtataaatgagtggtgaggaaacaaaaatgaagagagaatagagaactagggatgatagctggtgctaaccctatggctacgttggagttgcttgatggtcttgacaacgaagatttaacaggtgcctgagcgcaggcgataaggagtgagaccactgtatagtgaggaattagaataaagacctctatataaagccaggactttgaaaacctaagccttcattaaaaggtggatgtaaaacaaatcagccttcttgtaaagaaagatgacaaggaaacttgtcatagcctaggttc

SEQ ID NO: 384275 - DNA, 541 bp, Homo sapiens
atgcgtcctccggttggcggcggctgcggcggtggcggctacgagcggctccgtttttttaaagggaaacgctgaggcgccgggggtgactgtgggggagggggaccccgagccgcggagacccccgggagaggcgacagaccccctctcccggagtaggagggctttgggcggacccagccctccaccccctcctgaggaggaggggggggaaatggaggctcggggcggttgaggcgagctccggggcggggggccggggcggggaagggggggtgcggggtggggagacgaggcgggcccggccgggccagggggggccgaagcgagctccggggatgagctcgggggcggctgggtgcgagctcctgcctctgaggcgaaggcggcggcggcggcagcagaggcggcggcgaggcccccatgggccggcggcgggcctcagccgcggcctccacgtctccgcacgccggcgggatggcgcccgggccccggaggagccgcgctagcggaggcctgctgccgcgctgctgaggcgagc

SEQ ID NO: 384276 - DNA, 457 bp, Homo sapiens
gagccagaagaacagcagaattgccttcgcccgccctgcccctcgcctgctgcagaagcttccagaaactccctggtgggcgacccagcccgagctgcctggggccccaagggaagctgaacgccctgtgggctcctgggatggttcttcccgttctttgcgccgccttcacccattgaaggagcctgtgcccaccctgcccagtcgctttccgggccgctgaggagcttccgctgccatcttcggatcctgtgttccgcacgggggctccaccagggcagggatggtggtgagggtcgctcgtgggtcccctcgcggggagcagggtctggtactcaccagggcgcacgactaggacttgtggaatgaattcatcgtcgcctttagcttttagtcctttgaagagccctgagagtggaaatcaagagattttttccacggggaagttctttttaca

SEQ ID NO: 384277 - DNA, 493 bp, Homo sapiens
acacaaacacacacgcacacgttcatgcctagagtattctcaccatctctcatagcaccgttttttagtccgctctgccggagcttcaaaattccgcgatctttagacaactctagggtcagattttaatgtttaactttcattcaaagacgaggccttttgctttttcacagcccatttttctttccgcgtctggacagagctggctttagttggcgcccgagcacccgcagcttggggcaccaacctgcagcaacgggggatcagtccggcctgcgcgttgtaggcactcactccacagaggaaactatgtatttcgaaagcgtttcaaaaattccaccgagcctggtggccccgaaaaaccccaaggcccgccagactttggagaagggtctgtgaggtaccctcactgtcatacctacgccggcactctcagtcttttggagaagctactagagaagtgcctcaagaccagcctcggaggagcctggct

SEQ ID NO: 384278 - DNA, 317 bp, Homo sapiens
taggttgaccttttgtggaagggtagaatgtccaatcagggaaatgacctagcagaaagctagggagttcctcagcctcatgaattttttattagaagtcattcctaatttttatctttaaatgtacattttcaaggatgtacactagccacctctgattacagtaggcttacagcataaccccttttgcttcttggccccttttgcttcttttcagtgcctcttgggcttaatgaatagattttatcttcatgctaagcacattcatcatttaaaacatgcctggtatttgctgaagatgaattgaggagaaagtt

SEQ ID NO: 384279 - DNA, 1220 bp, Homo sapiens
atcactttacaactctgagcataagggcgggagcgctgatggcgggaaagcaagtcaacagcacgcccatcccacctgcagcatagggaccgcacctccccttgatttcatcggtgatattctatttataggacttcactcattactgtgaacacccaaacaactaatgctgtgtgtaagggggtctgcgccctgccactgatggtggagactgtgcttaggattagagtcttcgggggctccacttacaggtgaaataggcaggtctgggagcctggggccagggcgatgcctcttctcttctcactggaagtttgggagccttgctcagtgggggccttgggttttctggattcttgctaaagtgcttccttaagccctgagtcctctcttctccaaacaccacagaaacagccagtgccattgttatgcacattctcacaaagcaaggagctagagagagcaggtgccaggagaggactgagtggggcaggcacatggcaggcactggctggggcggatgggagctgccagcctgtaccctcccagggaaccccctccccatgtcacagggaacagctttgccatctactggagagctgtggcccatgacggtgggtgagatggctggtgctcatctctgccaccctggaagggggtaaagaacggcattgccttatattcattgttcagcaacatcttttgtctttaatgaccttcagaaaaaaaaaacaacctcattcatctctctgttttttcttaaataacacatgatgttgggatccttctggagtctgtggaatttgctttttaaagaggaaaggaacagaagaaggttcctgaccaggcatttttcatcctcacctatcacagtccaagaggaaatgagtttaaattgaagtcaatgaaatttgcagaaattcacgaaggtggcatttttaaatgtaaaattggtctttttggggaaagtaatggaattgtctttttaacaaagaggctttcaaccttttaaatgtactcaagatcccatgaggccactgctcattgcagtgcctgtccccagaggctctggttctcctgggagccagtgcttcctggcatgtgccagggctctgaaggctttggttgatcttggagtcacacgctgaaccttgcctccctggagatgagagtgacacgcagtcagctggggcacaggtcactaaggtgcccaacaaacc

SEQ ID NO: 384280 - DNA, 984 bp, Homo sapiens
agaataataataaagtaggaaaaacagccctcttaagaggaaggccatcttaaagctctaccagcttcaggtgagggctgatccagcagatcccagagaaacaggctcacagagaggggagggggcttgtctaagcttacccagcccggaagcatcggggtcaaagcttaaccccctgctggaaggtgtcgagagccaggcagccaagcctgacctgggagatggggaagtgggggcccccccaagctcgccgactgcccttcccagcctgctgccagtctgattccacagagggtgctctgaccgagtgtttaccaaaacatgtattaggcaagacccgggccgaatgtgggtggcaccgcccctgtgctgggccaggagaatgtgcccgcaccggtcccagatcctgtttccccagtgggttgtacaagacaccttgaacttctgcatgaactgggacattcagaattccctggagcaaccccctccctccaccctgtgccttgatatctcctattaaagcttgtgtttgaatgtctgttaatagacatgatttaattattgatattaattcaaatgtattaatttgaattattaacttattaatcatttgatgtcgattaaagcaatgatcttgatccaatgtcatctcctccatgaagtcttcctggattatctaaggtgcagccccacagccagggacagtggttcatgcctataatcccagcattttgggaggctgaggtgggagggttggttgagcccaggagttcgagaccagcctggacaacttagtgagacccactcccctcatctctacaagaaatatataaaaattagctgggtgtggtggtgtgcacctgtgatcccagctgctcaagagactgaggtgggaggattgcttgagcccaggaggtggaggctgtagtgagctgtgattgcaccattgcacttcagcctgggtgacagagagagaccgtctct

SEQ ID NO: 384281 - DNA, 926 bp, Homo sapiens
ctatggctttgccagaccccgggtgccgccgcccccatggaattgcaggactgttatctgagcaacgtcgacgggggagaacacccctgcccgaggttaaagatagcaccgctcgaatcacatcacaggccgaaaaggccagatgacccaccagggacattgaatccgtgtcccgagaggggtggggcgggggtgtggattcctgcggggagcttcgggactggaaaaaacagagggtgctctgaccgagtgtttaccaaaacatgtattaggcaagacccgggccgaatgtgggtggcaccgcccctgtgctgggccaggagaatgtgcccgcaccggtcccagatcctgtttccccagtgggttgtacaagacaccttgaacttctgcatgaactgggacattcagaattccctggagcaaccccctccctccaccctgtgccttgatatctcctattaaagcttgtgtttgaatgtctgttaatagacatgatttaattattgatattaattcaaatgtattaatttgaattattaacttattaatcatttgatgtcgattaaagcaatgatcttgatccaatgtcatctcctccatgaagtcttcctggattatctaaggtgcagccccacagccagggacagtggttcatgcctataatcccagcattttgggaggctgaggtgggagggttggttgagcccaggagttcgagaccagcctggacaacttagtgagacccactcccctcatctctacaagaaatatataaaaattagctgggtgtggtggtgtgcacctgtgatcccagctgctcaagagactgaggtgggaggattgcttgagcccaggaggtggaggctgtagtgagctgtgattgcaccattgcacttcagcctgggtgacagagagagaccgtctct

SEQ ID NO: 384282 - DNA, 354 bp, Homo sapiens
agaataataataaagtaggaaaaacagccctcttaagaggaaggccatcttaaagctctaccagcttcaggtgagggctgatccagcagatcccagagaaacaggctcacagagaggggagggggcttgtctaagcttacccagcccggaagcatcggggtcaaagcttaaccccctgctggaaggtgtcgagagccaggcagccaagcctgacctgggagatggggaagtgggggcccccccaagctcgccgactgcccttcccagcctgctgccagtctgattccacagagctgaagtcgggacctggagttctgctcattcgctcatctactcagtgactttcttagaccc

SEQ ID NO: 384283 - DNA, 414 bp, Homo sapiens
tttcattcatgctcagacgatataataggaggaatagaccccatgtccccatagacatcctccctcattcacagttcagccctccactacctcccacatggacccctggcacctgccttaacatcttctgatataagcacagaaattgatgtgattagacagctacattgtttggaaagtccccatccttcttataaacccaccctccctacttattccctgccaacaacacacacaatagtaagtttggctagagcctgcttgttatgaacaaggcttaggaatagggcctctttagggctagtcttctcatttccaaacacttatcagcagttccaaaatgaagagcctgaccttattactgggcacagctgattgtgtatgcattattagaaaactttctgtggtctcaca

SEQ ID NO: 384284 - DNA, 502 bp, Homo sapiens
tcctgttaggttgggagttcctagatggcagggaatgtcatctttccctgttcctggagcatcattctcaatacatgacctttgaatgggtggatgaacaaatgaatgaatggaacaaatgaatgaatgagaccaagagcagcagtatctgcaactccttgtggccattccgtgttcttgtgaaatatctctaaggttcccgtttgtgtctcaaagaatggtggctggagcctccatatgagtggaggaggccaacctctgacggcaccccacctaggccctcagagccgtcttcagagctggcctgggcctggcagtgagtgtttcctatgtggaaggcaacatttgcgctttgtaggactagcaaaagacctagaagagggcggagcatgggagctcatgtctgtaatctcagcactttgggaggtcaaggtgggaggactgcttgagcccaggaatttgagaccagcctgggtagcatagggagaccccagctctacaa

SEQ ID NO: 384285 - DNA, 190 bp, Homo sapiens
aggccatggttcaaagcatgttgtcctttagggggacatccttttgtatatcctccatggtggaggggagagtgttttgtaagccataaagctctgagctaacaggtgatcttaataatattatcttttcggggtggctttgactcttggagattgttaaggtcatctaagccacttgtgttggattaag

SEQ ID NO: 384286 - DNA, 297 bp, Homo sapiens
tgcgtttgtaaaaggaaaataaattaacaacaagtgtttgtttttcaagcatgagagagggcccacacctggctcaggaatgcagcctcggcctctggctcctgaggcccctgcaacagttgttagaggcctgcttccggtctcatgctgcccctgagcgtctagggatggtgggcagaccctgaactgggttcctaacccccctgtctaagacatgccagtgtcttcagccccttgtcgcctacattcttctcccactggttctctcattgtgcacgtccctccctacctcctgat

SEQ ID NO: 384287 - DNA, 665 bp, Homo sapiens
caaaattacaccgttgttgatatactgtattcccttctaggttttgggttaatacgtctgtacattttttcttttttaaaaagaaaatgagatcatactaaaagaatcacactgttttataaccttttttcccattcaccaatatgtactgaaaaacagtattttaatggctgtatagtttttccattatgttaatatgtcataatttactatgaatctcctgttgagttattttaattctaatgtttcactaaacatttttaaaaaacatctgcagtagaatcataacatacatctttatttccccaagataagttgatagatgctaagtgaaaaggtatgcatatttttgagggttttagatcctctctagtattctacttttcctattagtataggataaataagacaagatgactgaaatgaaaaggataggtgtgagacattaatattatcaattattcagcatagacatgtgtagattttatttggaatgctgcaagtaacatgtactacttgggtcaaaataagctcattacaaaataggttatcaagtagttcattattctagttaagaataaattgggtccctacgtttccctttttgacctaagacattttcctttgtaaagagtacttggaaactggaagtaccaatggatttt

SEQ ID NO: 384288 - DNA, 371 bp, Homo sapiens
agggaaacattttctagagcttttctgttttctatagtacgtagtctggtaggctctgaagtaagacatctggatttgaatccttgctcctcaaaccagactatgagcatggctaagttacataatgtcccagtgcttcagtttcattacagtgttgtttttaggtgttaattcaagtgaagcgcttatgacattgcctggcatatggtgaaatctcaacaagtatttatcattatccctggatatagaagtagttaaatttattgtagtacctggccagtcatagatgtttagtaagtatttattgactgaataacattcttctcattttctcattgttatatatttaatagttcctcagttattgaatg

SEQ ID NO: 384289 - DNA, 914 bp, Homo sapiens
ggagtggctttgatcagggaacatacatcagtaactgttttgtgaccttagtcccggctgtgttttatggcttggccaaagtttatcatataatttccactttaggaatttgcccacttactaaggctttgagggcaggggaggtgaagtagtattgtgggagaggagtaataaatgtgttttcttttcagtttctacagtgagtggtctgttttgaaatgagtgcaggtggttgcagtccactccctccacaaacaggacaaattaagatcattttgctctttcgggaagctgagggcaagcctgcacaggtgaggtcacgagaggcaagctatgtgcacacctggtgtcctcgtgcttcttgggcaggccagctccatgcagtgcagtgcccctgaagggaatggggccaggagaagacataacagggcatgaggatcttctctgtgccaagaatcatgctaggtaacccccctgagatttctcatcctcttgagaatcctgtgagatgatcctgctgcccttatttttccagatggaaaaacggattacccaggattcaccgcttgtgagtggcagaaagtggcagcattagaactgctgcactccatggatacatccagcacatgtgctctcctctagtgtgtgattccggttcatttaagtcagattttggattccactcaatgaagtttgtaactgctaagtttgtgatgtagcactgtaccgagctcaccaagcgcgtgggctctttgtgtctctcctggcgcctgggttagggctgtgctccccaatgtgtaccccaatgtgacagaggaacacagtcaacaggatgcaattccagaaaggagccccctgtgccctgcattccaaggctgaacttgggtggcattgtcctcgtactccccaacgtg

SEQ ID NO: 384290 - DNA, 435 bp, Homo sapiens
tccactcaatgaagtttgtaactgctaagtttgtgatgtagcactgtaccgagctcaccaagaatttcaactaacccactatgctcaaagtgtggtccatggaccaagtaccttggaatcccttgaaagcccctgttgaaaattcagattcctggccgggcatggtggctcacgcctgtaatcccagcattttgggaggctgaggcaggcagatcacaaggtcaggagtttgagaccagcctgaccaatatgatgaaaccccatctctactaaaaataccaaaaaaaattagccaggcatggtggtacacacctgtaatcccaactaatcaagaggctgaggcaggagaatcacttaaacctgggaggcggagttgcagtgagctgagatcacgccactgcactccagcctgtgtgacagagtgagactccgtgt

SEQ ID NO: 384291 - DNA, 162 bp, Homo sapiens
tttggaattggagcctaaaaataaataacttacgattctactcataattatttcctgctaatatttatgagcagagaagaattatataagcaacatgcatatgttatttatgctattttatgttatctatatgcagggcataattaagaatactcttcaaat

SEQ ID NO: 384292 - DNA, 337 bp, Homo sapiens
actagggagtaaaattaataaagggttaaagtaattttattattgaaatatatgaagaaaatacaaatatttaatgcatcaagtgtattatgttacatataaaagtaatctttagttaagttgttaaatctattagtactcatttaatgattagaagaggtatttggttttttaaggaagttttattttaaaaaaatgaggcccatacactttttaaaagtttatagtgaattaaattatttacttacttatttgcaagtgttactagtctcatacttaatgcatatctcttttttttgcaatttagataactgggcaaagtgtttctaaaaactaa

SEQ ID NO: 384293 - DNA, 386 bp, Homo sapiens
gtgtatagtaatttaatagtaattaaatgtagagtatttgtaaaaacaaggagaggaaaaagaacaactcatatttgagaactcctaataatcttctagagcagagttcaaagaagcagtggtaaaaataaagccaaagagatataggggctagtcttagaaccaggacttcctatagaaccagcttcctatagaatctgaactttatctgaaactctttcacagatctcctccaccttaacttccacaaaataagaaatttggattttgaggcaaatttgtatattttaaggagcaggacaatctcagctgtatctgggttgcagatatccaacaaatcctaccaaatcacttttcagctgcagactggaaatttcagatcagag

SEQ ID NO: 384294 - DNA, 551 bp, Homo sapiens
ctacttgggaggctgaggtgagagtatgcttgagcccaggaggtccaggctgcaacgagctggcattgcaccattgtactccagtgtgagctacagagcaagaccctgtctcataaataaataacccaaagctttagatatgtaaataaaatgtgtttcatattgcttaggaaaggtatagttggctggatgaaaatgtgtcttgctgctaatgtttcatatatcattttttctattaatttgaataacctttattgtttcatacaccaatttttctttattttttaactttaaaacattttctgttgtctatagctttatgttccttataagtaatttcttctatgagaaacctgtttctctttttaaaaaacctgttttgttttcttttttttaaaggctgtttttaaaaatcagttatatatatgcacatggtttaaaagtcttggtctgcgtatcctaacaaaaactaggggtgccctgcatgtttctttctcttgttttgtatttctagaggtaaccaataaagtattagggcacggcgacaaaac

SEQ ID NO: 384295 - DNA, 566 bp, Homo sapiens
tttaaatctaaatagctatatgtggataatggacatcatattagttaacacagttctagatgattctgtgcagaggctggttggttgccaaatatattattctgaccctgacaagggaaccccatccaagtagagtgattcacctttttaatctcaggtctattatattagttatcaagaccaaggctattgctattaacaaatgagaaaatctatagaattgccatggaaaccctattggagaaacacaggtttccatgtcaacccctgtccaggataccgctacaaaatgccctataagcaaaaacttctgaaaccacaatgttttctgactaatggaattaggagactgcgacttttgtccattgttcttaggcaaggcatttggggcccttccaagaagtagtctgaatatctgttataaggaaagaaaatgatacagtgtctaaaggcccttgactgaaaaatttgttttttgataaatatgtttttatctaaaggctctttgtcagaaatccttccttgggattatgcttgctgacttttctgatatgtttctattaaga

SEQ ID NO: 384296 - DNA, 495 bp, Homo sapiens
cctggtgtggtattgtaaattgtcgcttttagaccaactttttagtgatagaccctctctatgctttttgttgtaagctactgcagattcttgccacaggtatgaagtaaattctgttaatagccttgatttttcacctgtgccaccatatatatctttgccatggcctcatgatggatggaatatacttccctgccccttgacttgatacttgaccatgtaacttttttggaacaatgaaagatgatggaaatgtcagtatacctgtgctcaggtatactgtgctaggtcttaagaagcctccagtgtttccagctatacatctgcaatcaccatgagaaggacctgctcaagcaaaccactagtcacaggaggagaatgagagacacatggagcagagctgccctcagagtccacctagattagttgtcagcagacctccagtggacttgtagaaacacaagcaataataaaaggctgttgttttaaaaaact

SEQ ID NO: 384297 - DNA, 391 bp, Homo sapiens
ggtgcagcacaccagcatggcacacgtatacatatgtaactaacctgcacattgtgcaaagttaccttactgcataagccagtggttctcagcaaggagcaatgttgcccaccaaatttgacaatgtctagagatcttcctgactgtcgtgactaaggagatgctactgacatcgagcaggtagaggccacagatgctgctaaacatcctaccatgcacaggacagcccccacacaaagaattacacacctaaatgtcaacagtgccactgctgagaaagcctgctataagctaacataagagaagagcttctctggttaaagcaagtcaaggtggccggagagaatggagtggccttatgagagcaatacaccttgcaggccacatggcg

SEQ ID NO: 384298 - DNA, 526 bp, Homo sapiens
atccaggtaatttatatgcatactacattttgagacccactgatgaaagaattctaattttctatagagttactctagcaaggaaccttctcatttcttatgtattaggttatttctatatggaacatttcccagtagaccatattatttatggtatcttattaggtggaagccaaaagaacgttaaataatctgctggtgtttttgggttagttttgcactatttctcacagtgcaagcaattcttgttacctagtaaaacggttccccctttgaagggttgaatattgttcacatagcaccccagcctgtggtgtatatgtttaatctgtcaaatctcattaaatttttcttctataagaatgctaatgataccaatttctagaattgaatgatttctactctgcctgttggactgcaaatttgaaatcccctataataattagacccctccttagagtatattataatgaccatcgaacctgtatctaaaaattctagtaacttaaccatccagtcttaaaaa

SEQ ID NO: 384299 - DNA, 558 bp, Homo sapiens
acactcctgaagctcccttcagacctccagtgaagcatttctcttggaaacacacacataacccagacagagtaagagacattcccgccccactacttctgcaattgttgtagcatgggatttcttttcttttcttctcttttcttttctttcttttatttgtttatttattttatttttttggagacagaatcttgctctgtcgcccaggccggagtgcaatggcgtgatctcggctcactgcaacctccgcctcaagcgattctcctgcctcagctttccaagtagctgggattacaggtgcctgccaccatgcctggctaattttcatatttttagtagagacggggttttgccatgttgtccaggctggtctcgaactcctgatctcgggtgatccacctgccttggcctcccaaagtgctgggattacaggggtaagccactgtgcccatagcacggggtttctaaacctcggcactattgatattttggacaatgcttgaaatgttatggggggctgtcctgtgcattgcaggatgttcagcagcacccctg

SEQ ID NO: 384300 - DNA, 435 bp, Homo sapiens
atctgaagtgggaagagggtacaagttcccagggtacttccatagaacactgaaaactccaaacatgttgcacacacacaaaaaaaaattaagctattagttttaaaattattaaaaaataaatgacatctctatggatcaataataattcattctacaagcacttactgaacatcttccagcaaaacaacgatgctagtataatctggagtttcagctacaaacaaaatagttgagtttttgccttcatggggtgtacattacagagaataaaccaattcattatttaattagaattctaatatgtgctatgaagaagaaatacagatgttgcacttcttctgagccaagtttctgagaatatgaccttgaagctgaagtctcaaagaaggacaggcactatccaaaggaaacaagtaaaaaatggagaaaggt

SEQ ID NO: 384301 - DNA, 425 bp, Homo sapiens
ttttttttttgagacggagtcttgctttgtcacccaggctggagtgcagtggcgcaatcttggctcactgcaacctctgcctcctgggttcaagcgattctcctgcctcagcctcccaagtagctgagactacaggcgtgtgccaccatgcccggccaatttttttgtatttttagtagagacggggtttcaccatgttgaccaggctggtctcgaactcctgacctcagacaatccacccaccttggcctcccaaagtgctgggattataggcgcaagccaccgcgcctgcccattatttccatcttatagatggggtaaactgaggtacaaaccggttatgtcacttgcccaagtcgcatcgctgggatctgaaaccaggtcacctcgctccagaactcaggttctcagtcaccattagggat

SEQ ID NO: 384302 - DNA, 480 bp, Homo sapiens
ggggcaatgctatatttgttagaaaagaatgcaacaactcaaccacttgagatagtatatttccataatcatgtgtaagtaacacttaacaagaaaaattatcactcaatgtctatgagtaaggaaatgagagatgtatgcatttcttctacaacataatgctggacagaagaaccagtgtatagagaaagataagtagaaatagtgcaatgactgttaaccaagggtgattttgctccccagcggaactttgacaatatctgtggacagtattggttgttacagctatgggtagggggtgaggtgctcctagcatctagtgggtagaggctgaacaccctacaatctacaggacagcccctcacaacaaagaattatctggcacaaaacaatagtgctgagatggggaacccctgagacagcataagaaaaacaaccaaaaccaactgcttagtaaccaaaaaggcacgtcaaagaaaa

SEQ ID NO: 384303 - DNA, 705 bp, Homo sapiens
actcatgctgcatgtgagcagaacaagtcctgttacaatcaacagcctcacaaagaaaatttcagtatataaagcttatttatctcaggcagtattaattttggaccaaataaatgtactgttcccctgtcaacattttaacaggaacttaatttatgtacagaaaagagccatggagaggtgaatctccatctttggtttgcctgaataacctctttcttgaaatacaggatgtacaacttgcaattaatttgtcaccattctttgaactctcttggcccttgactaggagctcacagatgtttttcatccatcagtttagacaggtttgttccagtgtctttctcttctctttcaaatgactccagaatgcccactttcaaaatccatggtttttaataggtagcctcaaaaaaggattataatttattttaaattattcctaccctctagccccaccaaaagatgcttatgaaaaaactccccaaattaagtattttaatcttatggtcagtgtgtcctcatatctctagaaagggcacctacctggagaacctagggcaggagctgaggttcagtgtttctcaaccttgcctgattaaaatcatcacctgagaacactcattgaaaacacgtgttctaaggccccactcctatatattctgattcaggagacccattattgttgtaagaagaaaaagaaaa

SEQ ID NO: 384304 - DNA, 496 bp, Homo sapiens
tgtacctcactatgtcacctcagtgcccatcttgtacctgtctttctgttttcacttgttcattgctcattcacttgtctctgtcccctcactcacttctgattatctctaatttctttgactttggtagaagtagcttgtgcattactttgacaccaaatggctgggtaaaaagtgataaatcatccacttcaggtggtaagcttttcctacattatctaaatgtagtaatgtttctgtgaagcagtgctcgtattgataggtaagtgtttttgtttttgtggctctttgatcagatatttcccagtcctgtaatagagccacactaaaagtcacttcagtgcactgccttcgggctcatcttttcttcacatttctatcatgctttctggagtataaaggattttaactgagccacagaccaacatctcaacctcctgcttcacgcacaattgtatgagcttacagggatatcttagagatactgcaggtttgg

SEQ ID NO: 384305 - DNA, 433 bp, Homo sapiens
gagctctagattggtttccgcgtaggtccttgagagtttgatagcttgcttgatccattgatgaacaaaatatctgttgtggcccaactggatcaggcagttgagatctcaaggtttggtacagtgtctgaggaatttaggcagctgcaagacaggtgcttctaggccgagtgcggtggttcatgcctgtaatcccagcactttgggaggccaaggcaggcggatcacctgaggtcaggagttactggccaacatggtgaaaccccgtctctactaaagatttaaaaaatagccatgtgtagtggtgggcacctgtaatctctactcggaggctgaggtaggagaatcgcttgaacctgggaggcagaggttgcagtgagctgagagtgcaccactgcactccaccctgtgtgacagaaggaaaccctgactc

SEQ ID NO: 384306 - DNA, 350 bp, Homo sapiens
ccgagatcatgccactgcactccagcctgggcaacagagcaagactccatctcaaaaaaataaataaataaaagaatggcaggaagtaaaaacatccatttgaggaaaaacgaagcaatcagaactttaaagactagatattacaactctgaaacacttaacaaaaagtaaattcaccatgaaagtactaatttgtcatttgaatacaaaatgtttatcactataaactaaggggaaatgactaaatttatatgtatgtgtgtcctctgtagatatgtcctgttctctgacacctgtgggaagtaattgtccactgtttagcagaaattctgatttgcctcattttttca

SEQ ID NO: 384307 - DNA, 393 bp, Homo sapiens
gaggggattgggcagggaggtgagtacagcaggcgctcacaaagcggtcagctgtgggatgggaatggtcaactctgaagctacgggacttggagagagcctcagctgttggatgaaagagcgaaaacagatgcagtagttttcaaaccaagttccatggaggcattttaggggctttcctgggaaagcatgaagagctggaagaggtttatagccctctcctctctttccaccagaaatataaatgctttttctttctgtttcaacatgagattttatttgaaaaaatgatttcagtgtttttgtaataacttatttattgtagacatttttaagtacatgaaaatagcaagaataatataataaattctcattcttcaccaatgataattt

SEQ ID NO: 384308 - DNA, 1943 bp, Homo sapiens
ggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaaga

SEQ ID NO: 384309 - DNA, 2534 bp, Homo sapiens
ggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaagaaatgcatctgatctacttgtatttattgtctcagaattgtacgttgtgacaatcaaatgttacttgcctaaatgccaggaaattcaactggccttttaatcagcaagatcgccagcaagtactgtaactgtaaaggaaaatctctctctctggagaacccacacaaaccattgacctgagtgcgcatgacagccactggcttctttttctatgattgaaaatctgccatcgctgactgttggccagtttcaaagggacccattgtatacagggtgcaaatgtattatacggatgtttccttttgtacacttcatttttacaagttttgctactcacaagctttatgtagtggaggatagaggtatttttggtctttagaagcttgtcggggtgagggctgctaacttacacttcagaggcctgtgtcccaaaggcctggctgcgtttgccgtgctgtgcgaggacctgtgtacacaggcaggtgtgcgcctgcccgagcgcgagtagctcttgtgtagtggtgaaatgctgcaggcatctgtttattaaaattgctgctgtgaaagacagggataaaatatccacaatata

SEQ ID NO: 384310 - DNA, 1450 bp, Homo sapiens
ggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacaggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaagaaatgcatctgatctacttgtatttattgtctcagaattgtacgttgtgacaatcaaatgttacttgcctaaatgccaggaaattcaactggccttttaatcagcaagatcgccagcaagtactgtaactgtaaaggaaaatctctctctctggagaacccacacaaaccattgacctgagtgcgcatgacagccactggcttctttttctatgattgaaaatctgccatcgctgactgttggccagtttcaaagggacccattgtatacagggtgcaaatgtattatacggatgtttccttttgtacacttcatttttacaagttttgctactcacaagctttatgtagtggaggatagaggtatttttggtctttagaagcttgtcggggtgagggctgctaacttacacttcagaggcctgtgtcccaaaggcctggctgcgtttgccgtgctgtgcgaggacctgtgtacacaggcaggtgtgcgcctgcccgagcgcgagtagctcttgtgtagtggtgaaatgctgcaggcatctgtttattaaaattgctgctgtgaaagacagggataaaatatccacaatataagagaaagcgacaaaaagcctccttctgtttcttcgtttccagtctgcatagatgtctccaaggggaaaccagggccaccaggcactcctgtcccatggggccacccaccttcagagcccactcccacgggctctgtttccttggaggccatcctgccgatggcacttttcaaggccctcccttccctacgagttgctttctgggaggggaaattgaaaaggagagcggtcacctggcaaaaacacaggggaaatcagccagtccacaaaaatacgcaaaatgacctgatgatgtccaaaaaagggttttaaaagcgatcaaggacaaaaggttttcctaagtggcatgtatacatccaaaactactctttttttgtaaaaacattcatctgtggagaaaaccaaggaacccctttctcttctttattaaaaagcaaaacaaaaactcttgttagaac

SEQ ID NO: 384311 - DNA, 2992 bp, Homo sapiens
ggtttccttcccatctcacagcttagcttgtgcttctcaacaccaagtctttaagagcaataaaaactacaccatgaatgtttgaattttttttttttgggggggggagggtggattttgcttttcatccagaaggaaaaggggaggagagctcctttacattttttaaattaaattcataaatcccagaacagtcttttttttttctttttcctttacaccctacttctgagcttaattcagttgatgttatgtccaaattcaggctgagtgctcaggctgaagcaactctgtagcccacagtccgtgctggccactgtcggggtgaggcacattctaggcctggcatcgctgatgccctctgcacccagtccttgagccaggccgaggacaggaagggcattgctggcctgtagctcctgttacccacccagagccaggcgccacactggaggctcccaggcgggagggcccaggcccacccacgggcgtctggccggtcaagctcccagcctgggccgtggtctcctggggacgccgctggcctcccagcttaggcccaggtgccaggtgtcatggggtctcctgcccatcttcccaaggatgccattgctgtcttcatcgtcttcccccgtgtgagacactggttgtctggtactcggcgacagtgtaccagacgcgcaccctatgtgaggtgctttaaggtccctgtcctcaggaagcgcagtctggtggaagagatgagcgctgaacaaatcactaaataacacaaaacaacaatgtaagcagcactttcttgtgtaaaaaaaaaaaaaaagcacgtcctgtcgatgaattttgagtctctctgccttgcctgtcccgactccctttcgcgcaccgtggcatgagaatctttcctcacgctgttcgttgcggtattgctgagcattgatgttgatttgaaggaaaagccgtggttggacccagctgtgtgtttcactcacgtgcaattgagtagctgttgccaggctgtccatgcctgttgtgactaccggttggggtcagatttggggtgaagaatgagtaagtttctgcatgctttgtctctacctgagacacttctacaacaagccaagtataatctctccagccctgcagattttcacctgacttgttcagccccatgcgtagactcccgctgcaggcctctggcctgtggctcactgcatgcagcccctggcgtgcaatactagtgctccacggcgcgatgtgcttctagcccttgcactgcacctaggctcagggttcaaacggccagcccgaaaagcctgcctgccttctttctggaaacagcacgtccccggccgtgtgcctgcccctttctctactgagctagtccccaaaccaaaggcaagccccctcgggcctcgggggatggggccggccacacccctgactccgccctggctctgccccatacccctgccgtggggccgacctgggggatgcagacatccggctccgtattcctgcctatcggggccaggatgcaaaaacaatttttgcgtaaaagatgtcacactgatctgctggagtggggtggacacatgaattcagttttatcatgaacactcgccactggctgcttgttaattcagggataatggtggcattcttacaaactgctcgggaaatagaatgacgggaacacttttagggagcccaggaagttaccagggacattggtgtcgccggcccaggcaacagcagcgtacgcttttcaaagatcattgagttgtcttagaatttgaagctgtgtaatgacaatgtcacctggagttcgtctccatttcttaactttttgttgcacaagtatttggacagaagtcgaactgtgaatgagatactgaaatgcactaaattgtattacattaaactggagttacttgatacaatgaagaaatgcatctgatctacttgtatttattgtctcagaattgtacgttgtgacaatcaaatgttacttgcctaaatgccaggaaattcaactggccttttaatcagcaagatcgccagcaagtactgtaactgtaaaggaaaatctctctctctggagaacccacacaaaccattgacctgagtgcgcatgacagccactggcttctttttctatgattgaaaatctgccatcgctgactgttggccagtttcaaagggacccattgtatacagggtgcaaatgtattatacggatgtttccttttgtacacttcatttttacaagttttgctactcacaagctttatgtagtggaggatagaggtatttttggtctttagaagcttgtcggggtgagggctgctaacttacacttcagaggcctgtgtcccaaaggcctggctgcgtttgccgtgctgtgcgaggacctgtgtacacaggcaggtgtgcgcctgcccgagcgcgagtagctcttgtgtagtggtgaaatgctgcaggcatctgtttattaaaattgctgctgtgaaagacagggataaaatatccacaatataagagaaagcgacaaaaagcctccttctgtttcttcgtttccagtctgcatagatgtctccaaggggaaaccagggccaccaggcactcctgtcccatggggccacccaccttcagagcccactcccacgggctctgtttccttggaggccatcctgccgatggcacttttcaaggccctcccttccctacgagttgctttctgggaggggaaattgaaaaggagagcggtcacctggcaaaaacacaggggaaatcagccagtccacaaaaatacgcaaaatgacctgatgatgtccaaaaaagggttttaaaagcgatcaaggacaaaaggttttcctaagtggcatgtatacatccaaaactactctttttttgtaaaaacattcatctgtggagaaaaccaaggaacccctttctcttctttattaaaaagcaaaacaaaaactcttgttagaac

SEQ ID NO: 384312 - DNA, 1365 bp, Homo sapiens
tatatattatacaaatacagtattatgtatagtacgtttatgctgttttgagcctccttgccctcatcctttgattcttgcctttttaatttcttgccagtttactatttatactgacaaaagcaacttagagtgtatacacaaaagattttataaaatcagtttatgtcctagtatttataatcccagattttataatataaaccatagaattttcaactttagtgactaaggatttttgggcaaaagatatgtgatatcctttatatcctctactttatagccacacttctaatttgaggtaaatcctctccttcaattttcttatagtccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggtgagatttgattttatgtaaaatcatcactattttaaatactgcattacacattttttattaaagcataacacatttggaaagcattttgtgatatattatgtctgtactcttaccccaaggaagtttgggttcagcctataaatatgctatttagtagtttaattcttagctttgagaacagctttaatataggtggttcaagtaggaatgttcatttctgtggcaattgttaagagttccttgtacatttaagtaaatgcaatttacccaaaatacaggctaagttttaattaatactacattataattctgtctaaaaagtgtcaccttatacaaaattataatgtgtcattttatctaaaattattttattttctgaacatgaaaagatattgacattatctttaatgaattttctcaaatggccataggtgaccaaaacacaggtaagccagaatgcagacagctaattgcattaagatctcaaggttatcttacctagtcctctcagactaggctaaatgcaccttctctgtgatcctatgccgctttcatatatttggattgtaattagatacatgctttatcttctcgtagatttgtaaccttctcaatgggaga

SEQ ID NO: 384313 - DNA, 3099 bp, Homo sapiens
tctcgctccccgtgcggctctcgaggcagctccagtcccggacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtgatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384314 - DNA, 2274 bp, Homo sapiens
tatatattatacaaatacagtattatgtatagtacgtttatgctgttttgagcctccttgccctcatcctttgattcttgcctttttaatttcttgccagtttactatttatactgacaaaagcaacttagagtgtatacacaaaagattttataaaatcagtttatgtcctagtatttataatcccagattttataatataaaccatagaattttcaactttagtgactaaggatttttgggcaaaagatatgtgatatcctttatatcctctactttatagccacacttctaatttgaggtaaatcctctccttcaattttcttatagtccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384315 - DNA, 2071 bp, Homo sapiens
  misc_feature (113)..(113): n is a, c, g, or t
aatggggtggtactggtggttggtaacagatgtagaggggggtcatctcctgctccctcagtccactgttgtggatgtaggagaggcatttttcgaattaacccagtcagacnaaaatagaaaagagaattttaaaaaatgaacaaatccttttaaaaaaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384316 - DNA, 1576 bp, Homo sapiens
tgtttgtggatgtgtgtgtgtcaactttttttcttttatctaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384317 - DNA, 2856 bp, Homo sapiens
atacggatccgtcgacggccattaccaatcgcgaaaccacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggagatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctgggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggtgagatttgattttatgtaaaatcatcactattttaaatactgcattacacattttttattaaagcataacacatttggaaagcattttgtgatatattatgtctgtactcttaccccaaggaagtttgggttcagcctataaatatgctatttagtagtttaattcttagctttgagaacagctttaatataggtggttcaagtaggaatgttcatttctgtggcaattgttaagagttccttgtacatttaagtaaatgcaatttacccaaaatacaggctaagttttaattaatactacattataattctgtctaaaaagtgtcaccttatacaaaattataatgtgtcattttatctaaaattattttattttctgaacatgaaaagatattgacattatctttaatgaattttctcaaatggccataggtgaccaaaacacaggtaagccagaatgcagacagctaattgcattaagatctcaaggttatcttacctagtcctctcagactaggctaaatgcaccttctctgtgatcctatgccgctttcatatatttggattgtaattagatacatgctttatcttctcgtagatttgtaaccttctcaatgggaga

SEQ ID NO: 384318 - DNA, 3765 bp, Homo sapiens
atacggatccgtcgacggccattaccaatcgcgaaaccacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggagatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctgggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384319 - DNA, 3386 bp, Homo sapiens
atacggatccgtcgacggccattaccaatcgcgaaaccacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggagatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctgggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacagggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagtcttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtataagaaaaaaaaag

SEQ ID NO: 384320 - DNA, 3099 bp, Homo sapiens
atacggatccgtcgacggccattaccaatcgcgaaaccacgcaaccccggagccgtctcaggtccctggggggaacggtgggttagacggggacgggaagggacagcggccttcgaccgccccccgagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggagatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctgggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctctgaacaaagttgaaggagacaacattagtggagtttgctttgttggcctttatgacctggatgcttctcgctactttgtactcttgccactgtgcctttgtgtgtttgttgggctctctcttcttttagctggcattatttccttaaatcatgttcgacaagtcatacaacatgatggccggaaccaagaaaaactaaagaaatttatgattcgaattggagtcttcagcggcttgtatcttgtgccattagtgacacttctcggatgttacgtctatgagcaagtgaacaggattacctgggagataacttgggtctctgatcattgtcgtcagtaccatatcccatgtccttatcaggcaaaagcaaaagctcgaccagaattggctttatttatgataaaatacctgatgacattaattgttggcatctctgctgtcttctgggttggaagcaaaaagacatgcacagaatgggctgggttttttaaacgaaatcgcaagagagatccaatcagtgaaagtcgaagagtactacaggaatcatgtgagtttttcttaaagcacaattctaaagttaaacacaaaaagaagcactataaaccaagttcacacaagctgaaggtcatttccaaatccatgggaaccagcacaggagctacagcaaatcatggcacttctgcagtagcaattactagccatgattacctaggacaagaaactttgacagaaatccaaacctcaccagaaacatcaatgagagaggtgaaagcggacggagctagcacccccaggttaagagaacaggactgtggtgaacctgcctcgccagcagcatccatctccagactctctggggaacaggtcgacgggaagggccaggcaggcagtgtatctgaaagtgcgcggagtgaaggaaggattagtccaaagagtgatattactgacactggcctggcacagagcaacaatttgcaggtccccagttcttcagaaccaagcagcctcaaaggttccacatctctgcttgttcacccggtttcaggagtgagaaaagagcagggaggtggttgtcattcagatacttgaagaacattttctctcgttactcagaagcaaatttgtgttacactggaagtgacctatgcactgttttgtaagaatcactgttacgttcttcttttgcacttaaagttgcattgcctactgttatactggaaaaaatagagttcaagaataatatgactcatttcacacaaaggttaatgacaacaatatacctgaaaacagaaatgtgcaggttaataatatttttttaatagtgtgggaggacagagttagaggaatcttccttttctatttatgaagattctactcttggtaagagtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgattgggatcctctgccgccccgc

SEQ ID NO: 384321 - DNA, 572 bp, Homo sapiens
gaaagggagaaacacttcttgcctccataattcagacagtaaactgatcgctgagatttaagtttgcttgtttcctggggaagcttgaagatcctcgtgggaccaccatcccctgctcagtcctccctggaagggggcactggctgggtataagccgcgtcaccgttgggtttgtgactttctggatggtgcctgggtttcacctggggctggctgaggaaaggggaggcggtagggtctgctctgtctgtcaggggcttgtggcttggcgggtgggctttgccatggtctcgcctcttgagtccagccccgtcctgatggggcagacttctgttcgttctgcttcctgggtgatgtcaatactgaatgagagggcaagagaaggggaaagggaaccgccatatgttcttcacgtgctgcaagggggctgtgtggttcccatgaaatggtcagcagagactttgggatgggtatgactcgtgggtcacagggttgactagacagaatctaaagaaggtgggtgcttagctgggaagtctgcagtagggacggatcactgtgaagctctaggg

SEQ ID NO: 384322 - DNA, 244 bp, Homo sapiens
caaaaaactataatgtactacttcaaaacatgctaaagatattattaaataaattataccagatattagacagtaacaaaaatcagaaacaagaaaattcagaaatgaagtgacagacataaataatttcaaaaattaagactaaacccgaagcaatataaaagtgagtgaacacagctggcaatgtcttaagaaaaagagaagtcagaaagaaataaacatttaaaagtcaaaagaaataaaa

SEQ ID NO: 384323 - DNA, 308 bp, Homo sapiens
ttgcatcaatttagtcaggagtggagctgggtttgggttttgttgttgccttcagtgcaccacagtcttcagatacttccagcaattgactgctattactttatgcttcttagagtagtgcctgaagtgcaagatatttattttgagtccttttattttgaacctgtctgtgctatgatagatccccattttattcagagtccttaatatggtcagcaaggctctacgtgatctggtagagggccagatagtaatcatttaggattttgtaggccacataatctctgtcacaactatttaattctgct

SEQ ID NO: 384324 - DNA, 437 bp, Homo sapiens
tacatctatgttcagttgcttctatttttatttgctttctggtcagttaaaaaataatttaaatcttatagtgcctcaattattttgtctacaatgtgactttattaattgtagtcctaatcacatgcaacaggatcagtctctgacacctgtcaatattactctgtgaaaacaggaaattataaatttgaatgatagtgacccaacctaaacacagtagctattgagtatcctggaattgccttgattactattattttcttggtcatttatttccttcttctgacttaatttttggtaccacatacttgtagcataagctggaatggtccagtcaaatcttggaattagtaaatcattttatgttcccaaagagcttattgtctgtattattctggaaacataatttattgcgtttgcactttattccaaattta

SEQ ID NO: 384325 - DNA, 641 bp, Homo sapiens
gactggactacttggacttggtattcttatcccctgttttctacttcaggggaagtttctcaggtttttggagacaatctctgtagcgcctcacttgaggctcctcctccagtgccatttctctgcatctttcctgactcttcccattttactccgcctactgtatcaatactttattcagattgcaggtatttattggtgtctcttgtcccactgccacagtgacctcctcaagaatagtgaactgtcttatttttataccctatccaagcacaatgcctgcggtgtaggtgctgaccaaatatgttctgaatgaatgagagagagagagactgtggggatgggggtgatggaggatgggggtcggagatagtggtggtgatactcaccttaataaggaacttcagatattgaaagtgtggaacagaatgagtcctaaaaggaaatgaagtgataaggatgacaaaatgacacctttgacaatggatctctgctttagaatattgccatttgcatatatactgactgactgaataactggttttattaatttctccttgaagttcaaatggccatatagctattaaagtgtgtacttggtttgctaggaaaaattttaaaaacttaaacctccaacagat

SEQ ID NO: 384326 - DNA, 278 bp, Homo sapiens
ggttctttgaggcatacaagagctaatgaatataagggtatgatagacagtcagcaagtttttgtcattattacttttgctactgtgcatgtaacatttaatgtggtatggtgatcagtactctttggtggtagttttattttgttttaagagacaaggtgtcactatgttgcccaggctagactcaatctcctggactcaagtgatcctccccatcagcttcccaggtacctgagattacaggggcctggcttctgtggttgcttaataagtccatg

SEQ ID NO: 384327 - DNA, 752 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctggtgtgtctgccaggctggtatcccagggctctgagacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggtgggttctggaggagggcccctgtgcctctgatgctcctgtgcgcccagacgtaacacgtgtgtggcctggcctgcacagcaaggctgcagtcaccctttccaggaccctccccca

SEQ ID NO: 384328 - DNA, 3376 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384329 - DNA, 3670 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384330 - DNA, 1879 bp, Homo sapiens
acctcccctgctggcgcttcctgtcgctaccgctgcggcccagggcccgcgggagcccagggcggtgccgggtgagacaaggccgggaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384331 - DNA, 1560 bp, Homo sapiens
gactgcctcatcttctgcccaaaagagggagtagcgtggtgaatgggaaggaaccctgggtttggggttccagtgctgactctgccacatagagtcatctgcttctctctcttggccatctgtgaagtgagggtttgggtcagtggaaggctgcttcttcaagccaatgtttcttccagaagttgccgtggggattgaggagaaaatgaacagagctctaggatgcttgtctggatttatttattacttttttaataagactcacctaaaaccaccaccacctcctcctccaaatactgggagggtagggttttcatgaatggagattcctgtgttcatgccacaggacatcttagctcctctcacttctttcctgggaatgtagggacctgcctgctccccatctctgtccccttagttaccatttccctctctgtggtcctcacaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384332 - DNA, 1046 bp, Homo sapiens
gagccaagcccctccttgctttctccccctttgccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384333 - DNA, 3713 bp, Homo sapiens
  misc_feature (3691)..(3691): n is a, c, g, or t
  misc_feature (3693)..(3693): n is a, c, g, or t
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttaaaaaaaaaaaaaaaaaaaaaaaaaagatttgcggccgcaaatcttttttttttttttttttttaaagcataacaaatttatttaattttaaaaatcaaagtcttgcgtgacactggaaccttcagaaatgacacagatacccaggggaaaactgctgtttttttatgcttaggtttgatgaagaatgggctgtaaaccaaaaataaaatttgaagcccttcagccatctgaatgggcacctcctctcggccaagggcattctaaagttaacctgaaaaactagttcaggtcatgatcggaaggggggagtcaganangccttgttaccattcacgtc

SEQ ID NO: 384334 - DNA, 1646 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagcattgtgggcagctgcagctgtgtgcaacagtctgagcgctacgggtagactgtcagcgcgt

SEQ ID NO: 384335 - DNA, 5840 bp, Homo sapiens
  misc_feature (4344)..(4344): n is a, c, g, or t
  misc_feature (4374)..(4374): n is a, c, g, or t
  misc_feature (4385)..(4385): n is a, c, g, or t
  misc_feature (4391)..(4391): n is a, c, g, or t
  misc_feature (4398)..(4398): n is a, c, g, or t
  misc_feature (4405)..(4405): n is a, c, g, or t
  misc_feature (4431)..(4431): n is a, c, g, or t
  misc_feature (4444)..(4444): n is a, c, g, or t
  misc_feature (4450)..(4450): n is a, c, g, or t
  misc_feature (4470)..(4470): n is a, c, g, or t
  misc_feature (4479)..(4479): n is a, c, g, or t
  misc_feature (4485)..(4485): n is a, c, g, or t
  misc_feature (4488)..(4488): n is a, c, g, or t
  misc_feature (4514)..(4514): n is a, c, g, or t
  misc_feature (4555)..(4555): n is a, c, g, or t
  misc_feature (5204)..(5204): n is a, c, g, or t
  misc_feature (5232)..(5232): n is a, c, g, or t
  misc_feature (5240)..(5241): n is a, c, g, or t
  misc_feature (5255)..(5256): n is a, c, g, or t
  misc_feature (5266)..(5266): n is a, c, g, or t
  misc_feature (5286)..(5287): n is a, c, g, or t
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgaggtgggcagctctctgggccttcagaacctttgccccctccttttactcaactaactactcaactcatatctggagagaaaacctaggagtttctcatctatgagaaagacctaccatgctgggtagggcttatgggctgagtttctgatgttcctcagtagaactgggaagagaaggtaaccttccaaggtttaactatctatctatctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaattttatgtagacacgtttatttatttaggaaactaagtctaactcattgtagggattttatactcaactatacagagtatccaccaaagtcctaatctaaagtcctgctccctgtcactttttaaaagccagggtagcagtaacatgacaaacggctgctgtggcttcctcttgagagaggacagggaaagcctttcctcttcggctggttatgtggggaacttccttagtttttttccacaagaaattctcctttggctttgtttttctgaatggatggagactatgaaggggtttgtagttgtaagagatttaatattcaaaactgaaatattctgcatttcttagaaataccccatcttcccccaccccctttttgaattattaattcaagatcaacaaagcattcctcaagatcacttttaaaaaaggttagaagtgaagcaaatacattcagcttactgatcactatagtattgcataagcacagctcaagaactgagctttgtatgtgtccttttgggggataacagggctggaccatgcttccctgcccttaaacgcagagcttttagtgggtcacagagcgggaactacacacaagtgacttttttccccatgagccctctggccgattttttttttttttttttttttgagacagagtagctctctgccngccaggctggagtgcagtggcatgatctcngctcgctgcancccccncctcccnggttcangcgattctcctgtgtcagtctcctgngtagctgggattncaggcncccaccactatgcccagctnatttttttntttttngtngagacggtgtttcaccatgttggtcnggctggtctcgaactcctgacctcatgatccacccacctcngcctcccaaagtgctgggattacaggtgtgagccaccgcacccggctggccaatcttatcagaagtgagctaccaaaacttccacagatgtgagatttaacacttaattgcagtcacgtgtatgcaacacagcaataatctagaatgaaaaggagggtgattagccttcataagatgacctatagagcaaagaaaggtgactggaagggttcctaacccaacctactccccttagggtgtgtatccaacccagtgcttcctaagagggttacggaccactgtggttatcctctaaagttccagccagctctaggagtttctaaattcaggcctctgttggaaatggcctatttcgatagatagaaagttttctatagctctaaaggtttctcctttgcaacccattcaatttcagtctgctgctttgctctttcaaaacagaacctccaggctgacgaggcaagacaaagcctcccaccagacttggagattgaagttcttaaaaggcctttgttgtagccaaaggcatgcatgcgtcactggtagtaggaggagcctgtcccagcttcatcttgtcctgagatttatccacatacaggaaacaggcgggacacagtggctcacgcctgtaatcccaccactttggaangctgaggcaggtggatcacctgaggtcnggaattcnngaccagcctggccnncatggtgaanccccgtctccactaaaaacnnaaacaattagctgggcatggtggccggcgcctgtagtcccagctactagggaggctgagacacacgaatcccttgagcccgggaagcggaggttgcagtgagcctcgattgtaccactgcactccagcctgggcgacagagcaagactctgtctcaaaacaaacacaaatacagtatccaaacattggagattagtgactcacctgcagttgggagccagctacaacccaaatcattttaaaattttcaattctttgatctcatgcaatgcacactttcttctgaattagcaaactgaataaactacagaaattttttagaatcaagaagtcttgcttacaattaaagggcaaactcctgtgactctaacatttttcctttctcacagcaccattctgaaatttgcattgttgcttctggattttgaagccttgttttccaagtatttgtgggcagctcctaaaagactttgtcccttaagtaagggcagctgctttcaggatgaaaccatgcgactgagactggcagatcctgggagcttgcacctgggtca

SEQ ID NO: 384336 - DNA, 2643 bp, Homo sapiens
  misc_feature (84)..(85): n is a, c, g, or t
  misc_feature (91)..(91): n is a, c, g, or t
ggtctggcactctagtcagattactcctctaccaagtccaacaaaggcaggagcccaaactaagtaattcttcagcttctactnnagtccngtgatgacaactcatcgcctcccattctatcccaaaataacactcttgcctcccatggcctggcccagccttgtcatctctgaccacaggcagcccaccttcatcttatagataggggaaacaggctcagaaagggagctagactgagattgagtgagattggcctaagtgggggttgtttcagcccaggctcttggggtcccctgtctttcacccacacctgcttttccaacttctgcagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384337 - DNA, 3622 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagaggtcagcaggcccctcgtctgttcctcccctctgtgcccacagcctccccgtggaggaagacctggagctcagaccacacagccctggactcaaaattctcagctcttccacttactcactgtgtgacttgggcaaggcactttcttctctgaactacattttcctcatctatgagatggggtgataatacccctttcagggtggtacaaacaacagagaagagggaaagaacattgtgatgtgcgtaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384338 - DNA, 847 bp, Homo sapiens
ggtcaggcactgaagcctggtcaggcactgaagcctggtcaggcactgaagcctggtcaggcactgaagcctctatctatcttcaggaaaccctttctaaaatctttgtgttttcactgcagtttagactgacttcttgtgctttgcacccctgtgtagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccctaaggacttagtggagggggaaagttgtttttggtactacttggtgggaagtaaggggaaggttggatcttgggtttggtctacccacccaagagaaaagactgttaactggaagaaaaaatatatatataaaatttta

SEQ ID NO: 384339 - DNA, 3387 bp, Homo sapiens
acctcccctgctggcgcttcctgtcgctaccgctgcggcccagggcccgcgggagcccagggcggtgccgggtgagacaaggccggggtttggctcggattcaccgcgaggtatctaggctgccatgatgccaggccaagacctcggaagggccctcaggccagaggccaaggggtggccgctgccaagcagatggggctctttatggagtttggccctgaggacacgctgctgggcatggatgaggctgaagatgatgaggacctggaggctgagctgctggctctcacaggggaagcacaaaccacaggcaagaagccagcacccaaggggcaggcccccctgcccatggcccacatcgagaagttggcggcagactgtatgcgggatgtggaggaggaggaggaggaggaagggctggaggaagatgcagagctgctgacggagctgcaggaggtcttaggtgtggacgaggagactgagcccctggatggtgatgaggtagctgacccaggcggctctgaggaggagaacggcctagaagacactgaacctccagtgcagacagccgtcctgacagcttcagccccagcagctcaggccggagcatctcaggggctacacgctttgctggaggaacggattcacaactaccgagaggctgcggccagtgccaaggaggcaggcgaagcagccaaagccaggcgctgcgagcgcggcctgaagaccttggagtcgcagctagcctctgtgaggagaggcagaaagatcaatgaggatgagatcccacctccagtggccttaggaaagcggcccctggccccccaggaaccagccaacaggagccctgagacagaccctccagctccccctgccttggagtcagacaacccctcccaacctgagaccagcctccctggcatttctgcccagcccgtttcagacttagacccagacccgcgggccctgctgtcatcccgacagagagagtacaaagtggctgccctcagtgccaagcgggctggagagctagaccgtgcccgagagctcatgaggattgggaagagattcggtgctgtcctggaggccctggagaaggggcagcccgtggatctgagtgccatgcccccggcacctgaggatctgaagccccagcaggcttctcaggctcccacagcaccctcagtcattcccccagccgtggagcgagtgcagccagtgatggcccctgacgtcccagcaaccccagtggcccctacagagtcacagacagtgctggatgccctgcagcagaggctgaacaagtaccgcgaggcgggcatccaggcccggagtggtggggacgagcgcaaggctcggatgcatgagcgcattgccaagcaatatcaagatgctattcgagcacaccgagcaggacggaaagtcaactttgctgaattgcctgttcctccaggatttccccccatccctggcctggagtccactatgggtgttgaggaggacgcagtggcagcgacattggcagctgcagagaaactggcctctgcagaggattcagccccggctgataaagacgaggacgagaccagggtgagcccccagcacaggccccagtggccaagaaacctgcacggcccacagtcccttcatcccagcgcctgcctgagcccagggcctcaagttctaaggagtcaccgagtccatctgtgcgggagcagctggcactgctggaggcacggaaactgcagtatcagcgggcagccctgcaggccaagcgcagccaggacctggagcaggccaaagcctatctgcgggtagccaaatggcttgaggctcagatcatccaggcccgatctggcagacctgttgatctgtccaaggtgccttcgcccttgacggatgaggagggtgacttcatcctcatccaccatgaggacctgcgactctcccagaaggcggaggaggtgtatgcccagctgcaaaaaatgcttctggagcaacaagagaagtgcctgctgttctccaagcagttcatgcaccagggcaacgtggctgagaccacccgatttgagaagcttgctcaggaccgcaagaaacagctggagatcctgcagctggcccaggctcagggcctcgaccctcccacccaccactttgagttgaagacattccagactgtgaggatcttctcagaactcaacagcacagaaatgcatctgatcattgtccggggaatgaacctcccagcccctccaggggtgactcccgatgacctggatgcttttgtgcggtttgagtttcactaccctaactcggaccaggctcaaaaaagcaaaacagctgtggtgaagaacacaaactctccagaatttgatcaactcttcaaactaaacatcaaccgaaaccaccggggcttcaagagggtgatccagagcaaaggcatcaagtttgagatcttccacaaagggtccttcttcagaagcgacaagctggttggcacagcacacctgaaactggagcggctggagaatgagtgtgagatcagagaaattgtggaggtcctggatggaaggaagcccaccggggggaagctggaggtgaaggtgaggctgcgggagcctctgagtggccaggatgtgcagatggtcactgagaactggctggttctggagcccaggggcttgtgagccgatggccagcaccaggagaggagtcaggccgcgactgtgcaggagatgactttcccagctttgctggcttcagaagcctttgtacataagagatgctgctacccaagcaccaaagacctgttaagcatgtgcactactgaccacgactctggtctttcctgttgttggcccctctggggctctacagaaacaggctgggttccaggagcccatctccccgctgtctccccctgccccgagtctggaagagggcaaggacacttccattcctctgtaccatggagtcctgcagccccttaacccctgcgtggcaactgtgtacagcttacccctgcctccagttgcaccacttctagatgtgcctttaaaagatctaactatgggatgggagaacttgagggtgatcgggaacctcccctgctgagggtggtgtcagggttccgtgactccagtgggccagtggtagcctgtcccagacaactccgtcaccccagctctgcctgtgcctttatccctgacagctgctgcactagccttcctgcttccttaggcccttcctccggccactcctccctttcccattcgtctgtcttcgcttcctccgtccttcttttcttctctctcttctctccctctccgtccccatagatgaaaatgacttgttaacttggaagtataaatttatatataaaattta

SEQ ID NO: 384340 - DNA, 296 bp, Homo sapiens
catctctggaaaatgtttcacctctttgaaatttgttggctggctgaggtggctcaacctgtaatcctaccactttgggagtccaggagtttgagaccagcctgggcaatgtggtgaaaccccgtctctacaaaaaatacaaaaattagccagtgtggtggtgcatgcctgtattcccagctaattgggaggctgaggtgggaggattgcttgggcccaggagttctaggatgcagtgagctgtgatggcaccattgcattttagcctgggcaacagaggaagaccctgtctcaat

SEQ ID NO: 384341 - DNA, 433 bp, Homo sapiens
ttcacagacaagacaagattccctcagataactaagccattccctggccatgagttactacagtttcggtcattcattcagtggaaaagcgaccagggacagaaggcgccgccataaaggtcacctggcccgagcagacgccaggtcgctgcttcttccttggctgctgacattttaacagcggcccagacagtctgtttccgctttccccaaacaagcaccctggagaccctcccccgacggctcgaggcgagaaacggggcctggcccaggagccggtggccgcgacctcgggtatgcagtggcgccctctgcaccttgggaagcgcccgacgcacaggacagggaccgggcaggaggcaggggcggccccaggagaccgggcagcggacgggggagaccgcgggggacccggaaggggatgggggcggcc

SEQ ID NO: 384342 - DNA, 2421 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactgggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactgtcac

SEQ ID NO: 384343 - DNA, 910 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgcacaaacaaaaagaaaaaaaaatctttgggccgccggcccggaaagttttaaccatttttgggggcggccccagtaaaaacgggcacggtccaaaccgcggaggggttccaaaaaccgggacgggtgaaaccccggcggctggtccaggccctcacccgg

SEQ ID NO: 384344 - DNA, 645 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggtaggttaagatccttcataagggtattttcatgaatggctgtttttaactcaagtgaatacaattatttccatttaaaaagcaaggacaatgtgaatgtactcattgccactgaactatatacacctaaaaatggttaaaatggcaacttttatgtgtattttatgagaataaaaaataaataataataaaaaac

SEQ ID NO: 384345 - DNA, 2356 bp, Homo sapiens
tcgtgtctattcacgcgtgctgtgcattctaaccaggtactctcacttcacggagggtgtccgtgtcgctcctgaccctactccgaatagtccaagtatcaagaatgtctactcattgtacctatagtctaaccccaataaggcgcaccgcgatttttaatcagggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactgggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactgtcac

SEQ ID NO: 384346 - DNA, 751 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggaaatcctgggatggagcgcagtggtgaacatgagtcactgtagccttgacctcctgggctcaagccatcctcctgtctcagcctccagagtagctgggaccacaggataaaagtcttcatgttggcactcaatgtgccttaacaagaagatgcccacaagaagggtttgatcatcgggacagcaaagtgtctcttcaagagaaaaactgtgaacctgtggtaggttaagatccttcataagggtattttcatgaatggctgtttttaactcaagtgaatacaattatttccatttaaaaagcaaggacaatgtgaatgtactcattgccactgaactatatacacctaaaaatggttaaaatggcaacttttatgtgtattttatgagaataaaaaataaataataataaaaaac

SEQ ID NO: 384347 - DNA, 2787 bp, Homo sapiens
  misc_feature (46)..(48): n is a, c, g, or t
ccgtcagaaatctaaacccgtgactatcatgggactcaaaaccagnnnaaaaaataagtcaaagacgattaagagccagagaagcagtcttcatacacgcggccagccagcagacagaggactctcattaaggaaggtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtgtcctgtgccctgaccctacaagatgccaagagaagatgctcacttcatctatggttaccccaagaaggggcacggccactcttacaccacggctgaagaggccgctgggatcggcatcctgacagtgatcctgggagtcttactgctcatcggctgttggtattgtagaagacgaaatggatacagagccttgatggataaaagtcttcatgttggcactcaatgtgccttaacaagaagatgcccacaagaagggtttgatcatcgggacagcaaagtgtctcttcaagagaaaaactgtgaacctgtggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactgggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactgtcac

SEQ ID NO: 384348 - DNA, 426 bp, Homo sapiens
caatatgccatttaacctccttaagccaaacttagatctgggattatcttaccctccagctgcctcagtggattttctttcgaagctactgctttaggttctcctgaagcagaaacctgcccgtctccagctagagccttcacctggtaacgtgggcccctctcccgaacataaaaccctgtgttctgagagttgtttttcaaactgtcctttgttagtgtgctagatggataatgtcagctttttctcaaatctatcttgatttggggtcctctttgtcctaatgagtatttcacagctccatctatgaactcgcttccatttgcctggactcctgagagtggaggtacctggccttccagtgatgcataaagatgtgttttctttatccatttgaatcatctacccaccaagcacctatgtgtc

SEQ ID NO: 384349 - DNA, 3102 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcggggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagaggtggagtcttgctatgttgcccaggctggagtgcagtggcaccatctcggctcactgcaacctctacctcccgaattcaagcggttcttctgcctcagcctcctgagtagctgggaccacagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384350 - DNA, 3017 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384351 - DNA, 2572 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384352 - DNA, 2916 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384353 - DNA, 3068 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaacctgttccatggagagaagaggatggaaagtcaggctgcagtgacttgaatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384354 - DNA, 3160 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagaacctgttccatggagagaagaggatggaaagtcaggctgcagtgacttgaatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384355 - DNA, 2058 bp, Homo sapiens
ccgcgtgtggatcggacgaggacgctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384356 - DNA, 2690 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384357 - DNA, 2798 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384358 - DNA, 2469 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagactgtactccagcctgggtgacagagtgagaccctgtctcaaaagacaaaaacacaattaactttatactgttcttgttttatctctttcctccttttgttgttgttgctgtttatgatggagtatttcaaagcaaattgtaggcatgtcatttcttctgtatatatttcagtatatgcctctaacaagatacaatattaaaaactataatatctttaccacttcaaa

SEQ ID NO: 384359 - DNA, 2469 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgttatggaagaacttaacttttagaacatttaaacagaacataaccaggttttacagaggagatataaagcaatttctccataccttcaaaagccatatcttctggagaaaagaaagggctctctaggaaacacttgctcctctctggtatagaaatttcacccaagttacacaggccaggccctcttctctgaaaaacttaacaggtgaggtcagcatgcatttattcagtgcctactgtgtgcctggcaccatgggaaagacaaaagtagaagatagggaccttaaaatccagttgagaagtgaaagcttacatatatatgggaaagaacattgagtacataaaagatagtatat

SEQ ID NO: 384360 - DNA, 2343 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcagctgagccactaatgggcagtagtttgcttgaagaggcttcagtacccagtaaaaacctggtgtctatgaattcccagcccagccttggtggagagtccttgaacctaccaaataccaattctatcctgggagttgatgatgttatggaagaacttaacttttagaacatttaaacagaacataaccaggttttacagaggagatataaagcaatttctccataccttcaaaagccatatcttctggagaaaagaaagggctctctaggaaacacttgctcctctctggtatagaaatttcacccaagttacacaggccaggccctcttctctgaaaaacttaacaggtgaggtcagcatgcatttattcagtgcctactgtgtgcctggcaccatgggaaagacaaaagtagaagatagggaccttaaaatccagttgagaagtgaaagcttacatatatatgggaaagaacattgagtacataaaagatagtatat

SEQ ID NO: 384361 - DNA, 1975 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384362 - DNA, 1209 bp, Homo sapiens
gtaacgagcgctctttgaaagcactgcgactctaggatgataaccgtctatagattccgtaatctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384363 - DNA, 1173 bp, Homo sapiens
gggggtggcatcccatctataggttaacttctagtaatgaaagagaaggccagcttctgttgaaagaaaatgaggaccaggcacagccttgattgctgtatgtctctcacaacctattctctgtgcagctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384364 - DNA, 924 bp, Homo sapiens
atttttctgttgcttcacagaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384365 - DNA, 285 bp, Homo sapiens
cagtcctcccaccttggcttcccaaagtgcttgggattataggtgtgagcaccatgcctggccaagtttctgctgttaagtgcatacaaagataactggggaagatgaagatagatacctgattaatgatcactaggagtaaaatataggagctttattgtttgagcctaagtatctgagtagggtctttccctggattacaaatatgtgactctgttacaggagaaaatgtccaccttggttctggtgatgggcagtcaaaagattctgggccccttcctcaag

SEQ ID NO: 384366 - DNA, 713 bp, Homo sapiens
ctttccttaattattccaaatattcctttctaaagatccacctatcctgtttcatatgctaattcttcagacgctgaacacaagcaaggatcattatcttctaaggcttactctttcccttctaggtttattcttgtttctcgaaagtaggtgaaatagggggtggcatcccatctataggttaacttctagtaatgaaagagaaggccagcttctgttgaaagaaaatgaggaccaggcacagccttgattgctgtatgtctctcacaacctattctctgtgcagctgagccactaatgggcagtagtttgcttgaagaggcttcagtacccagtaaaaacctggtgtctatgaattcccagcccagccttggtggagagtccttgaacctaccaaataccaattctatcctgggagttgatgatggtaagacttccaactctcctttatttgggaaaaatgggctgcaactaggggctaaggaatggggtgtctccacaatgtatgtttaaatctcatttcttatgagtagctgtggtatgagtagcatttgtgttcttattctctggggtggattagtcaatctgtttaaaaaaaaattttttttcattgaagataatataataaaagaataaaaagaaaaaattcttaagaaaaaattattcctaatcctagcatcctagcccaactatttctatctttcctattgcag

SEQ ID NO: 384367 - DNA, 348 bp, Homo sapiens
caccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtcagttctttggctcttgttttata

SEQ ID NO: 384368 - DNA, 2845 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccag

SEQ ID NO: 384369 - DNA, 2876 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384370 - DNA, 3109 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384371 - DNA, 2902 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctcgcagcaagtatcttctagctcactacatgggggatcgcatcgtagcgtcgact

SEQ ID NO: 384372 - DNA, 2980 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384373 - DNA, 3072 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggtttgagatgctgttggatatacatgtggagatacctagcaagcagttagaaatgaaggtttggagttcagaagagatgactagagaaaaatgttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccagcccagccttggtggagagtccttgaacctaccaaataccaattctatcctgggagttgatgatgaggtgcttgctgaaggatccccacgttccctgtcttcagtgcctgatgtgacacatcacctggtgaccatgcagtcagggaggcaatcatatgaagtttctgtcttaactgcagtaaatccacaagagttactaaaccaaggagatttaactgaaagacggacatgagcgtgggtgctgactcctggaagagcaactctatctgatctcaaaatgcgtatactgggaacaggatgccttagcccacaacagaaccagaatgaatctttgaaggcacaagactctgcttttgccactcttcctctttcctggtatagaagatggatgtaggagagcttcttttctaactaccatctgatcagacaaggaatgaagcaatgactgtgggctgggaaactgtacctacctctcttcccactgcaaatttctgggatagaccaaaagtgaatttgattatgtgttggctgaagttcttcattctgactgttgaggggaggttttcctttgaagagttttcatcccagactcagctgtcttttcacatggatgaaataattcctgctaccaacaacagagcttcaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384374 - DNA, 2372 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcccaccaggaagttgagttttcaagatgccttgttgctttgaagaagggagtgatgtcaattctcttgttacattctccctttagcaacctgagtaagagactctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384375 - DNA, 2272 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcatatgagaaagcatcacctgcagctgggagcagctgggagtcaagagcaggagcaaactgctgagccactaatgggcagtagtttgcttgaagaggcttcagtacccagtaaaaacctggtgtctatgaattcctctctgccactgggctgcaaaaaaataaattacttgaatctccccttggcccaggctgaggtactatcttgtcctatacacttctacttggtcactttgctttcttcgttaatggaacatacagtagcatgttaagagggatttcatgtttttgtttttttaaagttaaaaattacatgatgcagagattcaggttttcctttaaataaacaaaacagcccagtca

SEQ ID NO: 384376 - DNA, 2064 bp, Homo sapiens
  misc_feature (1915)..(1915): n is a, c, g, or t
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggagagaagcctcatcagtgccaagtctgtgggaagaccttctctcagagtggaagcaggaatgtgcttngaagctcctgcgtgggcgcgtgggttcagagcggaggactgtggcccatggtcgacttgtgacagtcccccctcaccggggttgatcccccctggtgggtcttgccacctcatttcggggtgcggggggagccccccgttggcgggtct

SEQ ID NO: 384377 - DNA, 2032 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagagaaacctttcctttgtgaagcccaaggatgtggccgttcctttgctgagtattctagcctccgaaaacatctggtggttcactcaggtatcagaacctctgccattcatagattttaggaaaagtagacaaaagaataaaagggttgtgggggtgatataaagacaactaaaaagaaacaaactgttcactataaagatagaaagcttctcatcatcatgacagaatcagaaatcaaggcccttaattcttataatcaaggttggggggggg

SEQ ID NO: 384378 - DNA, 1845 bp, Homo sapiens
gcaaatattttaaaataagtaatttcaagaagtcagtcaaactcacaaagctttaacaaggtggcatccagcttggaagtcaagtgttcaagcccgcagtcgggacatccaagagctctttacatcctaattacaacacggaacccagactcactgcataccccgtcccgtatataatgcaaaacttgattctgcaagttcctttctcgggcggtgaaacttcgaaggtcctctccatggagacctttgataaatgtttaagcagtgatcttttctttcgcgtttgcctccattgcaacgcctccgctgatgggaaaaactactccctccgctactgcggggtggcagtgacgtcaacgaattagctgacctgttttttcgggcttcgcggacataggagttccgaaggccgagagtgagtgagtgagtgggagcggggcggctgcggctcctcctgtccggggcggagccctgcgtcgcgggcctggggaggccccgccagcacccttgacgtctgggtcccgagcagtgcggcagccacacgacactgaggcgagcgagtgggtgtgtgcgtggggggtcagccaaacttcctgtcccgcgctcgagctgcttccggcgggagccggaagacgctgtgtgtggacggaattcgggaccgactgacggccggccggcttcccggaactggaaggttacattgattacccacctagtacaacatcttacgggaagagcatagtatttcctagaggaatatgaacataacaggaaggtatcattggctctgaattaaatttgaacttgtcccctgaatagctacaggttttggaagctgaatcaatgttatcagatgagttagaatccaaaccagagctcctggtacagtttgttcagaatacgtccatcccattgggacaggggcttgtagaatcagaagctaaagatattacttgcttgtccctccttcccgtgactgaagcctcagaatgcagtcggctaatgttaccagatgatactacaaatcattctaactcctccaaggaggtcccttcctcagctgttttgagaagccttcgggtgaatgtgggtccagacggagaggagacgagagctcagactgtacagaaatccccggagtttttgtccacttcagagtcttctagcttgttgcaagatctacagccaagtgatagcacttcttttattcttcttaacctaacaagagcaggtctgggctcttcagctgagcacttagtgtttgtacaggatgaggcagaagattcagggaatgatttcctctccagtgagagcacagacagtagcattccatggttcctccgggttcaggagttggcccatgacagtttgattgctgctactcgtgcacaactggcaaagaatgcaaaaaccagcagcaatggagaaaatgtccaccttggttctggtgatgggcagtcaaaagattctgggccccttcctcaagtggaaaagaagctcaagtgtacagttgaaggttgtgaccggacatttgtatggccagctcactttaaataccacctcaagactcatcgaaatgaccgctccttcatctgtcctgcagaaggttgtgggaaaagcttctatgtgctgcagaggctgaaggtgcacatgaggacccacaatggagagaagccctttatgtgccatgagtctggctgtggtaagcagtttactacagctggaaacctgaagaaccaccggcgcatccacacaggagaggttcctttcctttgtgaagcgcaccgaagagcccgatccatggctaaggctgttacccgccgtaaacctctggccagtgaatca

SEQ ID NO: 384379 - DNA, 816 bp, Homo sapiens
ttcattccatcccatcaccccatgatccttccccattgtcccatgaccagcccccgcaggaccctcccctgctccatgtgaccctccctctgcctcctccatgaaggtctcctggatttccccactcgcctctcacagccctccattgtctctgcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgaggaccttgatctcccttatccaaccagtaacagtctcagggcccagcgcctactggtggggatttattgtgcctttgcaagaaagaaaggaattgagagactagaatcatcctaatttataatcttcatcatgtgcttctgatgacaaaaggctgatccaactcagatgggttcaagcgagaaaggt

SEQ ID NO: 384380 - DNA, 6311 bp, Homo sapiens
  misc_feature (2365)..(2365): n is a, c, g, or t
  misc_feature (2434)..(2434): n is a, c, g, or t
  misc_feature (2601)..(2601): n is a, c, g, or t
  misc_feature (6138)..(6138): n is a, c, g, or t
  misc_feature (6143)..(6143): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcggccctgngcccggccggcagcacggccagatccgcggctaccaggtccactacgtgcgcatggagggcgccgaggnccgcgggccgccgcgcatcaaggacgtcatgctggccgatgcccaggagatggtcatcacaaacttgcagcctgagaccgcgtactccatcacggtagccgcctacaccatgaagggcgatggcgctcgcagcaaacccaaggtggttgtgaccaagggagcagtgntgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccggggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384381 - DNA, 6218 bp, Homo sapiens
  misc_feature (2365)..(2365): n is a, c, g, or t
  misc_feature (2434)..(2434): n is a, c, g, or t
  misc_feature (2628)..(2628): n is a, c, g, or t
  misc_feature (6045)..(6045): n is a, c, g, or t
  misc_feature (6050)..(6050): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcggccctgngcccggccggcagcacggccagatccgcggctaccaggtccactacgtgcgcatggagggcgccgaggnccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgntgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccggggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384382 - DNA, 1699 bp, Homo sapiens
  misc_feature (31)..(32): n is a, c, g, or t
  misc_feature (1526)..(1526): n is a, c, g, or t
  misc_feature (1531)..(1531): n is a, c, g, or t
tggctgtctagaggataccattaggcgcgtnntgcgtaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384383 - DNA, 3199 bp, Homo sapiens
  misc_feature (2365)..(2365): n is a, c, g, or t
  misc_feature (2434)..(2434): n is a, c, g, or t
  misc_feature (2628)..(2628): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcggccctgngcccggccggcagcacggccagatccgcggctaccaggtccactacgtgcgcatggagggcgccgaggnccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgntgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccggggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgtttcattgttgaaaataaatataactttgtattcga

SEQ ID NO: 384384 - DNA, 6413 bp, Homo sapiens
  misc_feature (2392)..(2392): n is a, c, g, or t
  misc_feature (2461)..(2461): n is a, c, g, or t
  misc_feature (2655)..(2655): n is a, c, g, or t
  misc_feature (6240)..(6240): n is a, c, g, or t
  misc_feature (6245)..(6245): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcagaaacctttgaaagcactccgattcgaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcggccctgngcccggccggcagcacggccagatccgcggctaccaggtccactacgtgcgcatggagggcgccgaggnccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgntgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccggggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccagattcaggcctcaggagccccctcagggagccggggtttcactttgaaagcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384385 - DNA, 5082 bp, Homo sapiens
  misc_feature (4909)..(4909): n is a, c, g, or t
  misc_feature (4914)..(4914): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccatctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcacggctacagaggcgcagcctgcggcactcgcgtcagctggaggtgccccggccctatattgcagctcgcttctctgtgctgccacccacgttccatcccggcgaccagaagcagtatggcggcttcgataaccggggcctggagcccggccaccgctatgtcctcttcgtgcttgccgtgcttcagaagagcgagcctacctttgcagccagtcccttctcagaccccttccagctggataacccggacccccagcccatcgtggatggcgaggaggggcttatctgggtgatcgggcctgtgctggccgtggtcttcataatctgcattgtcattgctatcctgctctacaagaacaaacccgacagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384386 - DNA, 2991 bp, Homo sapiens
  misc_feature (2818)..(2818): n is a, c, g, or t
  misc_feature (2823)..(2823): n is a, c, g, or t
agggaggagttgtctcagagaatcatcactaaaggtctctgttgtacacatggggaaaccgaagttcagagaggttaagccacttgatcaaggtcacacagcatgggaatggcagagctagggctcaaagcaggccagtggcttggcttctcctcttaacccctatcttcaactcagcaagatttggggtagaggctgcctgtgtccagttcaatgaggatagcaattgtagtggccccatggggcacatcccagggctgagataagcctccttgtggtgtcgataggcagggggacaaacaggaaatatgagcaccattttccagaggagaccaaagctcacagaggttaaggaaggcactgagagtcacagaacaagcccttgatggccggcacaccctcacctttcttctttttttcccccttctcacctgtgtctgctttcgggaacagcaaacccgacaggtaagaaccagccctcccccgtggaggcttcaggcaagaggaagaggacagggaatgggctgatagtgtgcccacaggagaggggatgcccggctgcccccacagcttgtacacgtagctgtacttggtcctggaaaccctagtcatacgggtccatggtccttttcttaccatgcattcctggggcctgaattgtgttcacacatgaacatgtgccactactaactggactgttccgcttgcttctcctaaagtaaacgcaaggactcagaaccccgcaccaaatgcctcctgaacaatgccgacctcgcccctcaccaccccaaggaccctgtggaaatgagacgcattaacttccagactccaggcatgcttagccacccgccaattcccatcgcagacatggcggagcacacggagcggctcaaggccaacgacagcctcaagctctcccaggagtatgagtccatcgaccctggacagcagttcacatgggaacattccaacctggaagtgaacaagccgaagaaccgctatgccaacgtcatcgcctatgaccactcccgtgtcatcctccagcccattgaaggcatcatgggcagtgattacatcaatgccaactacgtggacggctaccggcgtcagaacgcgtacattgccacgcaggggccgctgcctgagacctttggggacttctggcgtatggtgtgggagcagcggtcggcgaccatcgtcatgatgacgcggctggaggagaagtcacggatcaagtgtgatcagtattggcccaacagaggcacggagacctacggcttcatccaggtcacgttgctagataccatcgagctggccacattctgcgtcaggacattctctctgcacaagaatggctccagtgagaaacgcgaggtccgccagttccagtttacggcgtggccggaccatggcgtgcccgaatacccaacgcccttcctggctttcctgcggagagtcaagacctgcaacccaccagatgccggccccatcgtggttcactgcagtgccggtgtgggccgcacaggctgctttatcgtcatcgacgccatgcttgagcggatcaagccagagaagacagtcgatgtctatggccacgtgacgctcatgaggtcccagcgcaactacatggtgcagacggaggaccagtacagcttcatccacgaggccctgctggaggccgtgggctgtggcaacacagaagtgcccgcacgcagcctctatgcctacatccagaagctggcccaggtggagcctggcgaacacgtcactggcatggaactcgagttcaagcggctggctaactccaaggcccacacgtcacgcttcatcagtgccaatctgccttgtaacaagttcaagaaccgcctggtgaacatcatgccctatgagagcacacgggtctgtctgcaacccatccggggtgtggagggctctgactacatcaacgccagcttcattgatggctacaggcagcagaaggcctacatcgcgacacaggggccgctggcggagaccacggaagacttctggcgcatgctgtgggagaacaattcgacgatcgtggtgatgctgaccaagctgcgggagatgggccgggagaagtgtcaccagtactggccggccgagcgctctgcccgctaccagtactttgtggtagatccgatggcagaatacaacatgcctcagtatatcctgcgagagttcaaggtcacagatgcccgggatggccagtcccggactgtccggcagttccagttcacagactggccggaacagggtgtgccaaagtcgggggagggcttcatcgacttcattggccaagtgcataagactaaggagcagtttggccaggacggccccatctctgtccactgcagtgccggcgtgggcaggacgggcgtcttcatcacgcttagcatcgtgctggagcggatgcggtatgaaggcgtggtggacatctttcagacggtgaagatgctacgaacccagcggccggccatggtgcagacagaggatgagtaccagttctgttaccaggcggcactggagtacctcggaagctttgaccactatgcaacctaaagccatggtcccccccaggcccgacaccactggccccggatgcctctgcccctcccgggcggacctcctgaggcctggacccccagtgggcagggcaggaggtggcagcggcagcagctgtgtttctgcaccatttccgaggacgacgcagcccctcgagcccccccaccggccccggccgccccagcgacctccctggcaccggccgccgccttcaaatacttggcacattccnccganttccttccaattccaaaaccagattccggggtggggggtggggggatggtgagcaaataggagtgctccccagaaccagaggagggtggggcacagaccatagacggacccctcgtcctcccccagcggtggtagggggacccggggggctcctccccgctctgcacc

SEQ ID NO: 384387 - DNA, 3727 bp, Homo sapiens
  misc_feature (2365)..(2365): n is a, c, g, or t
  misc_feature (2434)..(2434): n is a, c, g, or t
  misc_feature (2628)..(2628): n is a, c, g, or t
ctgccagcccgggggagctgtgactggggacttcgcagaaggcggaggaggcaacaggaccgcagagggggcagacgttgccccatctgacgctcggctcgaggcctctctgtgagggaccggggggccatccccctccagggcggagatcggaggtcgctgccaagcatggcgcccacctggggccctggcatggtgtctgtggttggtcccatgggcctccttgtggtcctgctcgttggaggctgtgcagcagaagagccccccaggtttatcaaagaacccaaggaccagatcggcgtgtcggggggtgtggcctctttcgtgtgtcaggccacgggtgaccccaagccacgagtgacctggaacaagaagggcaagaaggtcaactctcagcgctttgagacgattgagtttgatgagagtgcaggggcagtgctgaggatccagccgctgaggacaccgcgggatgaaaacgtgtacgagtgtgtggcccagaactcggttggggagatcacagtccatgccaagcttactgtcctccgagaggaccagctgccctctggcttccccaacatcgacatgggcccacagttgaaggtggtggagcggacacggacagccaccatgctctgtgcagccagcggcaaccctgaccctgagatcacctggttcaaggacttcctgcctgtggatcctagtgccagcaatggacgcatcaaacagctgcgatcaggagccctgcagattgaaagcagtgaggaaaccgaccagggcaaatatgagtgtgtggccaccaacagcgccggcgtgcgctactcctcacctgccaacctctacgtgcgagtccgccgcgtggccccgcgcttctccatcctgcccatgagccacgagatcatgccagggggcaacgtgaacatcacctgcgtggccgtgggctcgcccatgccatacgtgaagtggatgcagggggccgaggacctgacccccgaggatgacatgcccgtgggtcggaacgtgctggaactcacagatgtcaaggactcggccaactacacctgcgtggccatgtccagcctgggcgtcattgaggcggttgctcagatcacggtgaaatctctccccaaagctcccgggactcccatggtgactgagaacacagccaccagcatcaccatcacgtgggactcgggcaacccagatcctgtgtcctattacgtcatcgaatataaatccaagagccaagacgggccgtatcagattaaagaggacatcaccaccacacgttacagcatcggcggcctgagccccaactcggagtacgagatctgggtgtcggccgtcaactccatcggccaggggccccccagcgagtccgtggtcacccgcacaggcgagcaggccccggccagcgcgccgcggaacgtgcaagcccggatgctcagcgcgaccaccatgattgtgcagtgggaggagccggtggagcccaacggcctgatccgcggctaccgcgtctactacaccatggaaccggagcaccccgtgggcaactggcagaagcacaacgtggacgacagcctgctgaccaccgtgggcagcctgctggaggacgagacctacaccgtgcgggtgctcgccttcacctccgtcggcgacgggcccctctcggaccccatccaggtcaagacgcagcagggagtgccgggccagcccatgaacctgcgggccgaggccaggtcggagaccagcatcacgctgtcctggagccccccgcggcaggagagtatcatcaagtacgagctcctcttccgggaaggcgaccatggccgggaggtgggaaggaccttcgacccgacgacttcctacgtggtggaggacctgaagcccaacacggagtacgccttccgcctggcggcccgctcgccgcagggcctgggcgccttcacccccgtggtgcggcagcgcacgctgcagtccaaaccgtcagccccccctcaagacgttaaatgtgtcagcgtgcgctccacggccattttggtaagttggcgcccgccgccgccggaaacgcacaacggggccctggtgggctacagcgtccgctaccgaccgctgggctcagaggacccggaacccaaggaggtgaacggcatccccccgaccaccactcagatcctgctggaggccttggagaagtggacccagtaccgcatcacgactgtcgctcacacagaggtgggaccagggcccgagagctcgcccgtggtcgtccgcaccgacgaggatgtgcccagcgcgccgccgcggaaggtggaggcggaggcgctcaacgccacggccatccgcgtgctgtggcgctcggccctgngcccggccggcagcacggccagatccgcggctaccaggtccactacgtgcgcatggagggcgccgaggnccgcgggccgccgcgcatcaaggacgtcatgctggccgatgcccagtgggagacggatgacacggccgaatatgagatggtcatcacaaacttgcagcctgagaccgcgtactccatcacggtagccgcctacaccatgaagggcgatggcgctcgcagcaaacccaaggtggttgtgaccaagggagcagtgntgggccgcccaaccctgtcggtgcagcagacccccgagggcagcctgctggcacgctgggagcccccggctggcaccgcggaggaccaggtgctgggctaccgcctgcagtttggccgtgaggactcgacgcccctggccaccctggagttcccgccctccgaggaccgctacacggcatcaggcgtgcacaagggggccacgtatgtgttccggcttgcggcccggagccggggcggcctgggcgaggaggcagccgaggtcctgagcatcccggaggacacgccccgtggccacccgcagattctggaggcggccggcaacgcctcggccgggaccgtccttctccgctggctgccacccgtgcccgccgagcgcaacggggccatcgtcaaatacacggtggccgtgcgggaggccggtgccctgggccctgcccgagagactgagctgccggcagcggctgagccgggcgcggagaacgcgctcacgctgcagggcctgaagcccgacacggcctatgacctccaagtgcgagcccacacgcgccggggccctggccccttcagcccccccgtccgctaccggacgttcctgcgggaccaagtctcgcccaagaacttcaaggtgaaaatgatcatgaagacatcagttctgctcagctgggagttccctgacaactacaactcacccacaccctacaagatccagtacaatgggctcacactggatgtggatggccgtaccaccaagaagctcatcacgcacctcaagccccacaccttctacaactttgtgctgaccaatcgcggcagcagcctgggcggcctccagcagacggtcaccgcctggactgccttcaacctgctcaacggcaagcccagcgtcgcccccaagcctgatgctgacggcttcatcatggtgtatcttcctgacggccagagccccgtgcctgtccagagctatttcattgtgatggtgccactgcgcaagtctcgtggaggccaattcctgaccccgctgggtagcccagaggacatggatctggaagagctcatccaggacatctcgtcgacgcggccgcgaatttagtagtagta

SEQ ID NO: 384388 - DNA, 506 bp, Homo sapiens
cactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatacta

SEQ ID NO: 384389 - DNA, 463 bp, Homo sapiens
ttcgagcctttgacaattttctctgaaatacctcaaaatatttaatgtatagtttatgtgattaaaaaaaaatccttagctagtttttggaatacgtgacttgaagctttataccgttaaattataattttgcagacgatggcatgtcgtttctttgacgagttccgtgggagacgcattgaatgtcagggctggagaccagagggaaagttagagggagcgtgatcgcgagagagactgcggcagaaaggaccagtggcgtttacagatttcttatttaaatgagtcctttaggaaagaaaggaagagagagagagaaggcagaggtatacctttctgttctctggcttgttctgtttcttgttttctggagtcatgtcttataagagtatttattattctctgtgttctgtgttcaaatgtaatttaagaaaaaaaaaggaagaaaaatgcaaaaaaaaaa

SEQ ID NO: 384390 - DNA, 1119 bp, Homo sapiens
  misc_feature (1)..(3): n is a, c, g, or t
nnntgttttattctattaacagttcctaattagaatgcaaattacaagtcacataaagctggttgagaatggaagtactgagtactaatctcctaacttgcttatctttggatgtagacgaacaccaatgaactgagcaaattgtatgtgctctgttttttcttttccaaaggaattggttatctgtcttgtatttggggatatgtatgtatacttactatcaaatgaagaagataataaaataattcattgagtttcatgttaagaaagagtgtgagaaaagaagagagcagtaccataaatgtcagattaaaagaattaggtagctacctctccaggagaaaaaaatatggctaaatgctatctctacagcagaaacaaaaattaatttttgtttcagtgatgtttttgttttagatacttttatagcatgtgttgtagaatcacaaaattgagccctcgatatatataggaagtgtattcggtctagaataattaacttctccaaagtcacttagataataagggagctacaaattataacccagaattcaagattcctagaatagtattgtttcttccattttaaataaagttctgcagggacttaatgattctgcaaatgtacctcagaagctgtctttatttgttttaattattggagttccacgtttgaaaaaagaaaggttgaaaactttttgtactatatggatagtctatttttagacatgatttttgttttacgtactttcaggtcccaatcccaccttagagaaccatatctcttgttttattttagtgaggaaagaaatatacttttgctaaaatttactttatttcatgcgtttcttgaacatagtaaatgaggaattgcttttttgtgtgtttttgtagggtctcgtatagtgatatactagatcttagcaaggtaccaaaaatagctgcctcctgctgaaaagctttgtgaccacaaacaaagttgtgaactttgtcagacacagtgccagctacttggaaggctgaggcaggaagatcacttgagcccaggagttcaaggctacagtgaactatgatattgccaccatactccagcctgggcaacagagcatgactcatctc

SEQ ID NO: 384391 - DNA, 337 bp, Homo sapiens
caccatgccctgcccaaactgtagattcaggagcgaaattagtcattgatgatattttaggccattaagttttggagttacaaagccatagtaacctgaacatctgctaactgggtccaggactgttactattgctccacctcctcctcttcctcctctccgccgtgtgcttgagttgtgatgtgggttgtggtgtggtggtttagtgggtgggcaccgagccacactacctgggctcaaatcctgactctcacatatcaattgtatgactctaaggaagcaacgtagtctctctgtgcctcagttaccgtgtctgtaaaatgggggtgaaagtagt

SEQ ID NO: 384392 - DNA, 573 bp, Homo sapiens
tgggatcatgcttaattgtgttacaatataaagaagtcttcctccatggtatttatgggtatgaaaaaaaaagaagtctttctttgccagatatggattttgtacttccctcccttcaatttcatgtatactgttttttgtttttatttttctgattagttcccttggtatctgccctgccccatccccattcattttggtattcacatacccaataccatagtagcactttatatttactttgtttacgcctaattacagcctgcatattctagataaaacaaacagactcagccaggcacggtggctcatgcctgtaatcccagcactttgggagcccgaggtgggcggatcacgaggtcaggagatggagaccatcctggctaacaaggtgaaacaccatctctactaaaaatacaaaaaaattagccaggcgtggtggcgggcgcctggagtcccagctactcgggaggctgaggcaggagaatggcgtgaaccagggaggcagagcttgcatgagccaagatcgtgcctctctccagcctgggtgacagagtgagactccgtctcaaa

SEQ ID NO: 384393 - DNA, 404 bp, Homo sapiens
ctctacagagtggctggcagaatggtcctaagaaggccctgtccctcttctttacctttttaggactgacattcttttttagttacttctcacctcttctaggatctttgaggtagatgagaaggaaggcttcctcctcctgtcctaatcaggcatggcctcaaccctgtccctgtgtagcattccagatagcttaaagctgggtgcacctttgaaatgtcattttgtctttacacctttaggtatttattaaaactcaccatcagttccctgtgctatcttttctctaaaatagctaaggaaaaagtagtaagcagtggcataaaccagagttgtcactgtttctgaaacctgcatggtttcagaagagtcacaaaagcacaggtggcacctgggggcctgcc

SEQ ID NO: 384394 - DNA, 861 bp, Homo sapiens
gaaaagcaaggccataaagcccaaataaatagaatcaatgcagagaagactcaagctgcagctgatcgaaaagcaaggccataaagcccaagtaaatagaatcgatccagagaagactcgagctgcagctgatcgaaaagcaaggccataaagcccaagtaaatagaatcgatccagagaagagctctagatttgctaatttttccaactccacattcagctactggtgttattgttcaagagcaagatcttgtagaatggctttttcttccacatactaattcatggactctaactccttatttggatcaaattgctactatgataggaaatgggagaacttggattgttaaattacatggatatgatcctgaaaaaattgtccctctcacgaaggcacaaatacagcaagattttttaaatagtcttacttggcaaacccatttagctgactttgtgggtattcttgatattttcctaaaatgaaactgtttcaatttttgaaattagctaattggattctccctaaaataactaaatttaaaccaaatgaagatgcagagaatgtttttacagatgggtctagtaatggtaaagcttcttactctggctcgaaaggtaaagttttctagacaccctatgcttcagctcaaaaagtggagcttgtagctgtaattgaggtattgactgcttttaatatgcttattaatgtgatttctggttcttcatacatggttcattccacacaattaattgaaaatgctgagttacgatttcatacagatgaacaactgatgactttatttatgcaattgcaaacagcagttaggagtagaatgcaccctttttacatcactcaca

SEQ ID NO: 384395 - DNA, 231 bp, Homo sapiens
cattctagtcaatatacccccaaatcttattatatcaacaggtgatcgatataaaactatggacgtattttacattatttaaaaaataagtctttgggctgggcatggtggctcacgcctgtaatcctagcactttgggaggccaaggcgggaggatcacaaggtcaggagatcaagaccatcctggctaacacagtaaaaccccgtctctactaaaaatacaaaaaaaaa

SEQ ID NO: 384396 - DNA, 443 bp, Homo sapiens
gctgggatgacaggcgtgagccccacctgtcattaacctttcttaattaaaactggcccttgaatctttgatgaaggctgctaccatgggctaaaatgataactaaaatccacagaggacccaaaacccaaatcctgcccttttaggagacaagggcagtgagaaaacacttcatcagcaactcacagttaagcatctccaaactttccccaattttttccatctgagtaatcaggagtataattgaacacaatgaagtgttgaaagtttttcaatgtaatatagaagattaactatacaattatcccttacagagctaaaataacactgctcttgcatcacaatgtcttacataagattctttgaacttccttgaggctctgtaatagtttagtaccctatcattattgtcttgcagtccgcccatttttcagatgggaaga

SEQ ID NO: 384397 - DNA, 487 bp, Homo sapiens
caattccattccagctacctctctctggtcacagagaggtagtgctggatatgtgtcttacaaatttgcatgcttttctagaaaagatgatgggatccactaaaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttacgctggaatggaatggcaattccattccagcgtataggtttggtcctagcctttctattagctctt

SEQ ID NO: 384398 - DNA, 485 bp, Homo sapiens
ggtgccctgttatctggtaaaagagccacttatgacctcaggtgctacttaacctggggggcaattgtttcttaggcctagcagatgatgggatccactaaaaactcagtggtgagatgattcccttagcaagattgctgaagttaggtttagacgtgggagggtgggtatgtgagcaatggtgccaatagcggctctttatttgccttgtcctcattactgccatcaggaaggtgctactggcctcgagccaggtgttcataatctggccttgggttaaccagacaaatagaacttcttttcctagactgttggctttgtggaggttggcagcctctatcacaggataaaatttccaaatccatttacccagtatattcactacattttttcctatcctcccatcataaaagctgttacgctggaatggaatggcaattccattccagcgtataggtttggtcctagcctttctattagctctt

SEQ ID NO: 384399 - DNA, 386 bp, Homo sapiens
gggcacccaagtgaaggatcctgctgtgtactcaggggctggtgttgctgtcagggatgttagcctagagcctcagcttcctgtaaaatgaggatgatgatatccaacagcttatgggaccttgaagtcccagcatttttcatctttcaatctcacctccttttcctgataatagagaggcaacaagaactcagggcatgcaatggggctcaacttctactctctgccacaatttcatcatgattcccccaaagagcagagccccaggagccagcagggggcagggtgggcatttctggactggattcattcataataagatcaaaatttccaatccgtatgtctcgggtgccatctgctgatagatcggaccagatggtataatt

SEQ ID NO: 384400 - DNA, 388 bp, Homo sapiens
ggtcccaggaggcaacaccgactttgctgagtcccaagcctatcatgggctttcccacccagcctggggcaaggagtggaatacgcttagcccaggcaatggatggaagcaaactcccccaaggaaggtggtattagtctccctggccattcccagttggagttgatttgttcctttaagaaggggaaggattctcgagcactggagttttcaggtcccctcccagtcttgaaagtttgcaaatgactctgttttgcgggagggctgaggctgaagtcctgtccatctctatcctctgactctgaggactgaagactgggctttaggatctctgggtcttgaggaggcttggcacctgcagaatccactccaagactgcctgaagcct

SEQ ID NO: 384401 - DNA, 329 bp, Homo sapiens
gttaagtggagtcactatgtgttcctcttaactggaagatttctttcattcagtgtgaatactgaaacatttattttaccttttttttttttttctccccagcagagacagggtcttgctttgttgcccaggctggtctcaggcttctggccacaagtgatcttcctgcctcagcctcccaaagtgctgggattacaggcatgagcgacttagcctggtcaaacatttctttagttgtttgaaagtcatctgactatatctgtgaaattatgtttatttagaaaacatagcctttaattacaaattctgttattgtgtaaatgatgtgc

SEQ ID NO: 384402 - DNA, 3197 bp, Homo sapiens
taagtaattaagggtagttaaattatttaaagtatacaaagtccaaacagccaggggtaaggtctccaagaggccttcccagggtaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384403 - DNA, 3053 bp, Homo sapiens
catcgcccgaggcgtccgccctgcaaatctgccagcccccgagaggggtttggaaccttagcacccaagtctaagtcaacttcatagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384404 - DNA, 3556 bp, Homo sapiens
cggtccgatggcgacaggctcgcactaggacccaggcgccagagtgcctccgtctgtcctgtaggttcattcaatctcccatacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384405 - DNA, 3645 bp, Homo sapiens
gggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggattgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384406 - DNA, 3243 bp, Homo sapiens
gggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384407 - DNA, 3167 bp, Homo sapiens
taagtaattaagggtagttaaattatttaaagtatacaaagtccaaacagccaggggtaaggtctccaagaggccttcccagggtaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384408 - DNA, 3250 bp, Homo sapiens
  misc_feature (69)..(69): n is a, c, g, or t
  misc_feature (75)..(75): n is a, c, g, or t
cgcggggaggggtaaacaaaccacgcgcgggctgcccgcggcacggcgggcgcggctggcgcggctggngcggcnggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccatatgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384409 - DNA, 3255 bp, Homo sapiens
  misc_feature (69)..(69): n is a, c, g, or t
  misc_feature (75)..(75): n is a, c, g, or t
cgcggggaggggtaaacaaaccacgcgcgggctgcccgcggcacggcgggcgcggctggcgcggctggngcggcnggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384410 - DNA, 2013 bp, Homo sapiens
  misc_feature (14)..(14): n is a, c, g, or t
aaatcgagctcggnacctccttctggcacgcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384411 - DNA, 2918 bp, Homo sapiens
  misc_feature (69)..(69): n is a, c, g, or t
  misc_feature (75)..(75): n is a, c, g, or t
cgcggggaggggtaaacaaaccacgcgcgggctgcccgcggcacggcgggcgcggctggcgcggctggngcggcnggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcaaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384412 - DNA, 1687 bp, Homo sapiens
  misc_feature (88)..(88): n is a, c, g, or t
  misc_feature (92)..(92): n is a, c, g, or t
  misc_feature (94)..(94): n is a, c, g, or t
taagtaattaagggtagttaaattatttaaagtatacaaagtccaaacagccaggggtaaggtctccaagaggccttcccagggtaanggananggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384413 - DNA, 1229 bp, Homo sapiens
cggtccgatggcgacaggctcgcactaggacccaggcgccagagtgcctccgtctgtcctgtaggttcattcaatctcccatacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatcgtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctctttaaatgatgagatcggattggttggtgggctcttaaagc

SEQ ID NO: 384414 - DNA, 252 bp, Homo sapiens
tcttgtctaccatgcccaagagtttagacttcctgagacccatagggagcagttaaataattttaaagtggattatcatatgatcagcctgtgtcttggaaatatcgttttggctacagcttgaagaattggttggttgggagaagggataccagaggcatgaagatgcttttgaaggctattgcagtaatctaggtaagagatgatggtggccactgagatagaagtagacaaagtaaagagtatggaatg

SEQ ID NO: 384415 - DNA, 2460 bp, Homo sapiens
taagtaattaagggtagttaaattatttaaagtatacaaagtccaaacagccaggggtaaggtctccaagaggccttcccagggtaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagca

SEQ ID NO: 384416 - DNA, 3308 bp, Homo sapiens
  misc_feature (69)..(69): n is a, c, g, or t
  misc_feature (75)..(75): n is a, c, g, or t
cgcggggaggggtaaacaaaccacgcgcgggctgcccgcggcacggcgggcgcggctggcgcggctggngcggcnggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384417 - DNA, 3212 bp, Homo sapiens
cgcggggaggggtaaacaaaccacgcgcgggccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384418 - DNA, 3721 bp, Homo sapiens
gggtgctgggagataagaggaaggaggaacacggatgctggggggggtcaggggaagggacgaggccgggagaacactgagcgggggaaaaccggtggagaggggcctttgaatacctgcggggtgatgagatggggtccctttagcggtggcagcccaaggggctgtagagatggcgcagaaagaccaggaactcggagactgtggtgtcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggattgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgcttgaagaattggttggttgggagaagggataccagaggcatgaagatgcttttgaaggctattgcagtaatctagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384419 - DNA, 3496 bp, Homo sapiens
cggtccgatggcgacaggctcgcactaggacccaggcgccagagtgcctccgtctgtcctgtaggttcattcaatctcccatacacacagactcacagcgagaccgacacacactcccatacactcacacacacaactgcaggcagcgaggctcgggaagtcaggccggcttttcgccccggcgccttctctgctccagccggccgggtctccctgggggcccggagctcggccgggccgcgcagccccgttagaggacgagctcggcggacccccgctcctccatgggcaaacgcgggcggccgcgcaaggaggcgcgctgcgagggcgcggggctggcccccgccgcgcccccggctgtgccccccgccgtggccgcgccccagcccccggccctgcccgaggaccccgctggggccaagcccaggtgccccttctcagacattttcaacaccagcgagaactcgatggagaagcacatcaacacttttctgcagaacgtgcagattctgctcgaggccgccagctacctggagcagatcgagaaagaaaacaaaaagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384420 - DNA, 2792 bp, Homo sapiens
acagttgactcctgaggaaaaacaaccggcaaccgactttggattgttcaacaaagccaattccacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384421 - DNA, 3254 bp, Homo sapiens
  misc_feature (69)..(69): n is a, c, g, or t
  misc_feature (75)..(75): n is a, c, g, or t
cgcggggaggggtaaacaaaccacgcgcgggctgcccgcggcacggcgggcgcggctggcgcggctggngcggcnggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattatttttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaacatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgttgcatatgtacaggattatgggctggaaagcatttgttataaacctatagtgcacattttaactgccccctaaattacccttccctgggtttgttttccttggggtggtgtagattgtatgagtaagaagtattaattttttaaaagacaaatcaactttgaagacacaaaagttaattggaagaaataaaaactgtgaacgaagaata

SEQ ID NO: 384422 - DNA, 428 bp, Homo sapiens
acttaagttgctttaacaaactaactccaaatctcagtttcctgataaagatacatttttcatttacatcactgtgcaatgtgactaagggtaggggtataagtctgttccatgcagtcactcagggacccagtctccttttgtctggtgactctgttgatccaggcagtctttctctgccaattcaggatgagatgtttaggtaagtattttatttgtgaaatgattgctatacatactcatttttaaataattcaaaatcagtagcaatgcaaaaatattctgattactttagccttatggatattatgctttgaagtcatgagtgggagttgccttaaatgttaaaatgaaaactttgtggttttaacagctaattcttttgctttctgtaaatgtctactaaagaatctagacttttctctatg

SEQ ID NO: 384423 - DNA, 2453 bp, Homo sapiens
gggtaattagtatatccatcacctcaaacattttttgttcctttgtgttgtcagcattcaaagtccctttttctggctttttgaaaacataaaataaattatagttaaccatattcaccctatagtgccacagaaagtgagaactcattcttcctgtctagctgtaattttgtatttgtgaacccacctccctccatcctctcctcccctacccttcccagcctacagtatccacagttctactctctataataaaaggaaacttgttgacagtacaacatggtatttggcttatataggtggtatttgaggctcattctgaatgtacatttttctataatggttatatatatttatgctaataagtgactcctttcttttaaaatagaatatttcagtgctttagtagtaaaattgctttcagttacatcatcaaaatctttatcattatattttagtgataatacccttgtttttatgctttaatagactgggggagggagagggaaatgtattaaacaccttaagcttagagttaaaactttaaacatcaagtgtattctcttctgactgaaaggtttgtaagagaattttgtgatcagtcttctatcattatttgttctctttgtaagaacactggcagacacatgttgttcttttagaggatatttgaatggtataaatggcatggaaaagtgtttaagaaaacacacacatttctttgaacatttcaaagtaaaatgatcataattgttctaaagtgggtatccataagagtagctggactgggcaaggtggctcacacctataatcttagtactttgggagggcaaagcgggagtatctcttgagcccaggagttccagactagccttggcaacataggaaggccctgtctctacaaaaaaataaaataattggcctggagtaggtagtaagacagtaaacaaactggaaagtccagctatttttaatttccaaccaaactgttgaatcaattaaaaaaaaaaacgagtctatagtgcctttcaaatgcctgaattttgacatttgtacatcagctgatggattaatattttgaattgctatgtgatggctctgcatgggcatggtggccagtgcttcagttttgacagcattaccatccttggtgatgacatggacagcaatgtttctacaattgtttgaaatggtaaatatatttttgattacatgctgccttttaggcatacgcttttattcattccaagtatttatcgaacctgctgttacaggatacagtgcatcctgcataaggatacagtgatgaacaaagcagacaagatccccgcagtcctgtagtttacattcttatgggacaaagactaatagtgaacaagtaaaacatgaaataataatttccatgtagagaagtgtaatgggttgatgtgatagactgacagtatgatttctttaaatcgcatattcagggaaactctttactatgaagctaacatttaactaaagactaaatggggaattggcagtgccacgatcataagaatggcttttccagatagggaagaggttgtgctaagttactaatccaggaatgagtttggcatgtcaaagaacagaaaaaaggggccactaaggctggagcttagagaggaaaggagacaatgttatgagacgggtttggagagactggctgggacctacgtcataaaaggtttttgtaaggtgatctgaagcattggattttatatagtgcgatagaagctttcagagcatttgagatagggaagtattgttacctgataaatatttgagatttttaaacacagtcttttgcatgtgatttataatttggcataaatagaagtttaaatcagtggcaatcagttaaggctgggcaagttcctctctaaatggaggtgtgttacaaaggaaaatcagtaatagtctgtaagtactcaaaactatctcagcaaggtctaggagttggggaggtagaaagacagaggtaaaaccaatctttttggtgggggaggtggggattggaagggttaaggtggaaaaataaaaagattttgaaggtctcatcccattagggatataatataatttgcttgaggaaatcatttgaatcttggtaactgtaataagcattgagagggaaggtaactatattcatttgttaaattcagtaaggaagcaaaagagtatgttgtgcaaacagtgttgtataaaaataggagaaaagaggaaacaaaatgaaataataaacataaatagaaatataaaaagtaatagagtaaaatgaaaacaagtcctatcagtagttataataactgtagtcagtatatttaacaaaagacatgctgatttgattaaacccagctatactacattgtttacaagcatcatactaaaataacaatgtgaaagtaagtttaaagccacaagagatg

SEQ ID NO: 384424 - DNA, 580 bp, Homo sapiens
gctttctgaatactaatgaacttatttgccaaaatttaaatgttcttcttgtcagtgaatgtctgtctctcttaacaggatccaaattgaataatgaagaaaattagactctattgtaccctcaggagaaatcgtggtgaatcgtaatagaatacagagggggaaaggggtcacattttagaaaaaaagagtagataatttggattattaaaaaagggattaactcaggaaaactctgttcttttcaaagaaacgtactcatagtcattcaatgagcaggatttcccactgcacaagcatctatacctttggccagtgtagaaagagagtaaggtcataatcatatggagatgcatgctaggtttcagtagttacaatttactaatctcattcccatataaggcctttatatgcctgtaatggaatgggaaaatcaataagctttgaaaaggaacactattcttcagagaagttcaatgggagatagttgagttggggaaattgccccagttcttcctttaagcatgaaatgaggctgtccctatgtatgtttacttccattgccttggtgttatcactg

SEQ ID NO: 384425 - DNA, 445 bp, Homo sapiens
gttgatagacattggcattggggttgcttccaccttttggctgtcatgaataatattgctatgaacactaatgtacaattctttgcctgaacgtaaatgttttcatttctcttgggtatttatctagaaatgaaattgctgtatgttaaccctttgtttaacctcttgaggaactggcagacttttccaaagcagctgcaccattttaaattctaaccagcagtgtttgagggttccaatttctctatatccttggtaacacttgttatctgcccttttggttagagacatcctagtgagtgtgaagtggcatctcactgtggttttgatgtgcatttccctgatagctaattgtgtggatcccttttgcttttagtgaatgaaatatctggtagtctcgtatgccaaactaaagctaaaaattaaaaatgacttctgaaatgaa

SEQ ID NO: 384426 - DNA, 235 bp, Homo sapiens
aaatatctacagtgaaaattccctccacctaaacgtagcactcttgaaaagctcacacagaaagctttctatgaagactcaggtgctcttccacatttttccaacacatcctctgcttccactgggtggagaacttgtcacccagtgtctgaattactagtgtgcttttctctctcctgctagatccttgaaggacagcactgtgccttggtctccagggaccccagaagcacac

SEQ ID NO: 384427 - DNA, 323 bp, Homo sapiens
gcttagatgcctctatgagcagagaagtcactggccaataagataaccctttctattttggaacctcttttaaaaatagttcttatagtgaactcaaatctaagggactaaaacccagctgcccatgctgaacacctgggaggtacttcagcagagtggctctgatgtgagacggcctgggtctgatcctaactccctcactgacaagctgggtgacctcagacaagttacttaacctccctgggcctccttcctctcacaacaccagcaccagaggaagcagtgtgagggagcaggaatcacatataggaaaagtggaggac

SEQ ID NO: 384428 - DNA, 429 bp, Homo sapiens
  misc_feature (122)..(122): n is a, c, g, or t
  misc_feature (145)..(145): n is a, c, g, or t
  misc_feature (165)..(165): n is a, c, g, or t
  misc_feature (169)..(169): n is a, c, g, or t
  misc_feature (171)..(171): n is a, c, g, or t
  misc_feature (194)..(194): n is a, c, g, or t
  misc_feature (201)..(201): n is a, c, g, or t
  misc_feature (209)..(209): n is a, c, g, or t
  misc_feature (213)..(213): n is a, c, g, or t
  misc_feature (285)..(285): n is a, c, g, or t
  misc_feature (347)..(347): n is a, c, g, or t
  misc_feature (352)..(353): n is a, c, g, or t
  misc_feature (360)..(361): n is a, c, g, or t
  misc_feature (415)..(415): n is a, c, g, or t
  misc_feature (429)..(429): n is a, c, g, or t
acacttcacagggatgaatataaaagatacggtctctgcctttaagtagcttacaatccagtagagggaaagggacaaataaaccccaaatcaaacaattaaataatttcagctagccatcnaatatagtataaagaaaatccangcagggtgcagtggctcatncctntntaatcccagcactttgggaggcnggggtgngtggatcncctnagctcaggagtttgagaccagcctgggcaacatggtgaaaccccatgtctatgaaaaacacaaaatttagcnaggcatggtagcacacacgtgtagtcccagctacacaggaggctgaggcaggagaatcactngagcnntggaggnngaggctgcagtgaactgagattgtgccattgcactccagcctgggcaacacagnaagacttgtctttn

SEQ ID NO: 384429 - DNA, 231 bp, Homo sapiens
ctccagctaatcactgccatccaggttatcagctttgtgctcaagctggctcttcctgtagctgcagagctgtcccagcttttacttctacatgtggcaccttccagagggaaaagaggactgtccgttctggtatgcccttcttaggagcatagatgccctttccagaaaagcctgccagcaactctgctggtttccatgcagcccagctttgagaagggagtgggatac

SEQ ID NO: 384430 - DNA, 270 bp, Homo sapiens
ggtggaggctgcagttgagccgagatttcgtcactgcactccagcctgggtgtcggatagagaccatatctaaaaaaaaaaaaaaaaaaaaaaaaaaaaatagagaaagcaggttgctaacatattcagagctaaaatatggttatcacttttgaaatattaagttctcctcaatcaataagtttaatttccaaagaggaaagtaagttcatttttataaaatcatgttttttcactcattgaaaataataagtttgaaagtagacctct

SEQ ID NO: 384431 - DNA, 972 bp, Homo sapiens
actgaatatccttcaacactttgatctgtagagcagacaatagggcaggtttctgcagtcaggttcatatataatggtccttatatcaggatgtgaatgagtatggcgtttattgagtaccggagaggattactgtagttatgcagacaaattcttttttaatggtatatcagtgttgcacagcagattttttgagtaaatatgtcacttactattactgcgcagtttcatatcagtgttttgttagtgtaggtttcttaacattgagttattgtgtttttttgtttcacttttgtattataattttagacagtttgcaattcggtttatctcttataattaagagataaatcagccatatgtctgtcacaattagatatatatgtgtgtgtgtgtttatctataaatatgaccccaatattggttatggcttatcttgtatatattctttcttagccaattttcagtggttgttttatctcacctaagtgagtagtcatggaaatattttcaccatctcttattttcaccatgtgtttaatgatgatgtttctctcacctttgtgtgagagaaacacttttgtaatttgaaggtaatttttgaaaagatttataaatctgtatttttttcagtttttcctttagaaaaattaattgttgtaaaaacacataatatttaccatcttaaatctatttaggtgtaccttttagggccagacatggtggtggctcacatctgtaatccaggattatttgagctcaaaagtttgagaccaacctgggaaacatatggagagtccctctctacaaaatgttttttaaaaatagccaggcatagtgttgtgcatctgtggttcaggctacttgcaagactgaggtgggagggttacttgagcctcagagtttgaggccgaagtgagccataattgtaccactgcactccagctttttgacagagtgagactgtgtctc

SEQ ID NO: 384432 - DNA, 1959 bp, Homo sapiens
  misc_feature (2)..(2): n is a, c, g, or t
  misc_feature (633)..(633): n is a, c, g, or t
gntgtctttagttttactgtctggagaatcagatgcacaccttcacttagctgtgaatgtcacctccacccagcccagtgcccagaggccaaaatttggcccagatctctccttacctcctagccccagcaccaggtgtattcatcagaggagcccaggtggagggtgcactgggccctctgccaagcttcctgtggggacggcaggcccagtagcctttcggccagcccgtctctgggggcactgcctgctgtggaacggccagagctcctgttcctaggtgggtgaccagaccccacacagcatgggcaacctggcccaggtcccttatctctctgtcccctggtccctttgcccaaggaaaggcccccctctccacaccatctccctatttttggaagccctctttgcagacttctccctgctctgggagtcggagcttgtgggccagccttccatctccccttgcaggtatgtcagtggcacctcccagtgaggagatgggttcaaggggagggactgggttggccttccctttgcatggtactgagtgtggagtgtgtggcaaatgcatcacacaccatgtgtccctggagctgtataaatgaggctggtctagggggtccaggactngctttatccaggaggggagcaacggacctggccacttccatccccacagccctgtttctgtgtttttggcaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctctttt

SEQ ID NO: 384433 - DNA, 316 bp, Homo sapiens
gaagatgatgagctttgcatgtaaactcttcagtatagtgaaaacctgggtatcctgagactgtattcccatggttgctcattgtactgggtcagcaaggaaaagcaatatgaccagctgggggtagaggtcagctctgaatggaggactatgatggaggacagcgggaaaaatcgatgagcgccacctctttaaaaactcacttacgtttgtcctttttcactttgaaaagttggaaggatctgctgaggcccagtgacatgtggcagtgctcaagtgtgatagcctctgggagtgtgtgtctttgtttttacgt

SEQ ID NO: 384434 - DNA, 3888 bp, Homo sapiens
ggttggactttccttcccggaggcggcacccaaacagctaccccgtgcggaaacccaaacttctgctgccacttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaa

SEQ ID NO: 384435 - DNA, 3483 bp, Homo sapiens
aagcgcactgaccataagagcaacatgtgggcaagagccgcggcactggggtaatttattgccgccgctcgcttcaccaggaaccccacacgctgggttcccacaggatgcgacattcccacaggatgggacaactgcatggaaacccacactcgggcctgtgttgagcaaccacgtttgagtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaa

SEQ ID NO: 384436 - DNA, 4105 bp, Homo sapiens
ttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagcctggccagacgtggatatggttatgcacggactccgttttgtggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaa

SEQ ID NO: 384437 - DNA, 3967 bp, Homo sapiens
ttgacacagctagccatcagaacgtcctccagtcccatctgagtcctgttcctcctcaggcacctcctccaggaagcattcccagatgactggcccatcctgccctttccctcctctgagccgcaccctgcagacggccctctacctgtgaatccatacaggatgtaggcaaaggggaagaggtttgctcatcctctctccttcacccttgtgcatattaatactcacctggcaattagtcatatgcaactcttatattgaccttacatgttccgtgtcttctgtgcccgtctctggagttcctgaagatgaagggctgtgtctgctgcaccttcagactttttgaaattgattggttggtttgtacatccatttattcaccccacccctcatcctactgtacacgcttatggtcagtctattctgtgtcgggctcagggcctttctccccaaagtgcgttcatgtccaaggctagagtggatggctagaggccagaggacagcttaggctgaaagtggtagggagactatcaatgaagctggggggagctgagcttctgaaacttgggaataaattttcagccttgctaatgtgttcctctgaaaaaatatcttatcaggccctcagatatccaccagttctccctttccaacttgcagcctgcacccttggccaggaagttcataggcaacaaaatagaatccaccttccctatcactcaccccttttaaaatgtgactaactctgagctaaccaagcctggccagacgtggatatggttatgcacggactccgttttgtggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaa

SEQ ID NO: 384438 - DNA, 2611 bp, Homo sapiens
ggttggactttccttcccggaggcggcacccaaacagctaccccgtgcggaaacccaaacttctgctgccacttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctctttt

SEQ ID NO: 384439 - DNA, 2643 bp, Homo sapiens
ggttggactttccttcccggaggcggcacccaaacagctaccccgtgcggaaacccaaacttctgctgccacttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctgcgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctctttt

SEQ ID NO: 384440 - DNA, 3046 bp, Homo sapiens
ctttgcaaaaggtgtctcagagccaagctgtgaaggccttttaacagaccaccttccttctgattcccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaa

SEQ ID NO: 384441 - DNA, 162 bp, Homo sapiens
ttgtgtcttttctgtttttatttcttgtttacaccagtgtttcctgaaatttattctataaaacatgaattccaaaggacctttcatacaaaaggggttttatggtcaaagaagtttgcacactactttcatgcatattaatataatcaagatgctgagaaa

SEQ ID NO: 384442 - DNA, 759 bp, Homo sapiens
gtgaattccagaagttcacatttctgagcaccattaatttgagatcacttaacagctccttcacatcatactctcattacacttactatttttaagttggtctttttgtctctccttctagttacaagctagaaatgtattggttttttatttgtattttattttctcttttttgaaatagagccttgctctcttgcccaggctggagtgcagtggcacgatcttggctcactgcagcctctgtctctggggttcaagcgattctcctgcctcagcctcctgagtagttggggattacaggcacatgccaccacaccaggctaattttttgtatttttagtagagatggggtttcaccatgttggccaggctaatcttgaacttctgatcactcaggtgatctgcctgcctcggcctcctagagtgatggaatcacaggcgtgagccaccactcttggccagaaatacattggttttttaaaatgttctattattaaaacaattttttcttgcttaaatttggacttgttttgaatacaactgcttggtttcagaaaagggtgtctataaagaataaaggttattttactatgacactgatgtatttctctaaattcaaagatgaatttctagaaatttataactacaactaaaataggtttttgttcctctatttaatatttttttctaatatttttcctctgtttaatcttggatggattttccagttctgtgtttttccagcaaatttctgccaaa

SEQ ID NO: 384443 - DNA, 1295 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384444 - DNA, 663 bp, Homo sapiens
gcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccctctcctccccctttctctctaaggatggcccagaaggagaactcctacccctggccctacggccgacagacggtaaggcccttccctccgtccctgcgcccccatgaccccgcatggcgagttcctgctgggaaacttgagatcctgcaatgagcaatcctttaagcactttcttccccgttatgctccaaagtacgggtcccaagtttgacgacagaacccgctctggtcatttgtagccacatcctgtcaggtgctgccaacgtgaatctgaccagccagtgactcccagctggtgaggacctctgcagggctcgtcacatacaaatgatatctgggactgagcaggcagggcctggccttcaggccatgattcccaacccatatcctga

SEQ ID NO: 384445 - DNA, 1567 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaaaaaaaaaaaacaaaaaacacaaaaaattcggagaggatctacatagcacgggaggcaggaaaaacgaggggactatgtgagacaggtggggaccaatgtgggcacaattagcgcgtgatacaccatggagacccaaaggatactccgtgggtcccaacagcgcgggctaggcactcttggcacggggaccacgccaataatacgtgagagccgcgcactaaaaatctccggaataacggcccagggtttaacccccgggcgtttaagtaacc

SEQ ID NO: 384446 - DNA, 1289 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttccaaaatataatttctacatcctcaaaagataatcaaaggatgaagaaaatata

SEQ ID NO: 384447 - DNA, 1468 bp, Homo sapiens
gcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384448 - DNA, 1213 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgtgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384449 - DNA, 1347 bp, Homo sapiens
tacaggcaaggtagaggcgcggtgaaatcggacgaggagtgctggacctctcctccccctttctctctaaggatggcccagaaggagaactcctacccctggccctacggccgacagacgtacgggtcccaagtttgacgacagaacccgctctggtcatttgtagccacatcctgtcaggtgctgccaacgtgaatctgaccagccagtgactcccagctggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384450 - DNA, 1240 bp, Homo sapiens
taagggagagcgggggcgacggccgaggacagctgaccactgtgtcccctccttaggaggcccagaaggagaaccctacccctggccacggccgacagacggtcccactggcgaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384451 - DNA, 1077 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384452 - DNA, 941 bp, Homo sapiens
cggggcgggagatttgaaaagtccttggccagggcgcggcgtggcagattcagttgtttgcgggcggccgggagagtagcagtgccttggaccccaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaagatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384453 - DNA, 1138 bp, Homo sapiens
gcctcctgtcgcaggccttgcgccgggagtgggcagatgatcaggtagatcagagggtccgttgggctggcctgcgcgcacgccgcagggctggaaggaggtagggacgatagcagggcgggggcggtgagaccagcgcccagattggggctagtgtgctgacctgctcccttttaccagctcgggctagcgcttccggctcgatcggtccaacccctccctctctctctctttttctctgcttctcacggctgtttcccttctccgcccctctcctccccctttctctctaaggatggcccagaaggagaactcctacccctggccctacggccgacagacggtaaggcccttccctccgtccctgcgcccccatgaccccgcatggcgagttcctgctgggaaacttgagatcctgcaatgagcaatcctttaagcactttcttccccgttatgctccaaagtacgggtcccaagtttgacgacagaacccgctctggtcatttgtagccacatcctgtcaggtgctgccaacgtgaatctgaccagccagtgactcccagctggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384454 - DNA, 1519 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaaaaaaaagctgaaatctatcaaaaataataaaaaatgggggggggccatcacttaaattatacccgagagggggaacagagagttacgtctaccagcgtttttgttagaaagacggtgcccctaggatgaccgcgatataaaacgatcgaccaggtgccgatgtatacacagtgacaatgtggaaaaagttgtgactatggaacacttgtgtaagcagaccacat

SEQ ID NO: 384455 - DNA, 1264 bp, Homo sapiens
ttaggctctagtagagacggggttaatcggacgaggggcggcgggagagtagcagtgccttggaccctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384456 - DNA, 1271 bp, Homo sapiens
cggggcgggagatttgaaaagtccttggccagggcgcggcgtggcagattcagttgtttgcgggcggccgggagagtagcagtgccttggaccccaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384457 - DNA, 1222 bp, Homo sapiens
cggggcgggagatttgaaaagtccttggccagggcgcggcgtggcagattcagttgtttgcgggcggccgggagagtagcagtgccttggaccccaggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcaccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384458 - DNA, 1199 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384459 - DNA, 1582 bp, Homo sapiens
cggggcgggagatttgaaaagtccttggccagggcgcggcgtggcagattcagttgtttgcgggcggccgggagagtagcagtgccttggaccccagctctcctccccctttctctctaaggatggcccagaaggagaactcctacccctggccctacggccgacagacggctccatctggcctgagcaccctgccccagcgagtcctccggaaagagcctgtcaccccatctgcacttgtcctcatgagccgctccaatgtccagcccacagctgcccctggccagaaggtgatggagaatagcagtgggacacccgacatcttaacgcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcagtatgggttgatgccccctgagccgaagcccctctgctccctcacccccagctcctcattcagccccacttcatccagattgctttctctgtagctatggctagtgagccccatttagctcttagtcctggcaagccttgaatccagaaatctgcctccagtttccccttaccactcccagccctggtgtccccggcctgggccacgtctgaccccagtttgctcctatcatcttttccagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacgatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggaggaagacaatgtgtggcaccctggactacctgcccccagagatgattgaggggcgcatgcacaatgagaaggtggatctgtggtgcattggagtgctttgctatgagctgctggtggggaacccaccctttgagagtgcatcacacaacgagacctatcgccgcatcgtcaaggtggacctaaagttccccgcttctgtgcccacgggagcccaggacctcatctccaaactgctcaggcataacccctcggaacggctgcccctggcccaggtctcagcccacccttgggtccgggccaactctcggagggtgctgcctccctctgcccttcaatctgtcgcctgatggtccctgtcattcactcgggtgcgtgtgtttgtatgtctgtgtatgtataggggaaagaagggatccctaactgttcccttatctgttttctacctcctcctttgtttaataaaggctgaagctttttgtactcaa

SEQ ID NO: 384460 - DNA, 351 bp, Homo sapiens
aaaaaaaaaggagttttcatcaggattgtggtgatggggaatgagcagctcctctcattctaactggaggccaagtgtgacttacaatgctcacgagtaggatgaagacaagcagtggctcagttcgcttttgtggaaacctggagggctgacccattctagctggggcctgggcaaggagaggctggggaaagcagggtagaaggggagggttcctgccacgggaattgtcagctcgcagggcagtagtcgtcaacagaaggaagtcacgttacaggcagggcttctagcctttctcgaggccattagttggccttaaggccagggctgaactttccaggcctctctgaa

SEQ ID NO: 384461 - DNA, 444 bp, Homo sapiens
cctagcttgacatcatggggtttctccctacgtatgtacagatggatattcagccacagacttaaagtcaccccaacataaatttctataatgttttctctgcatattctatatctgtggaaattttagccacttctgcctctctgaaatctgagctctttgactaggctcttccagatcactctcaccccttgccccatgctgctgtctggtaattgcctcaaggtagaaaatgtgaacaattacaaagtttaccatatcgtgtccattctgtctctgccgtcatagccctgcactacctatatagtccaacatatgaaaatagtgtttattttctatctattttttagttttctaattatggcaggagattaattctggattctaatactccttcatgattggaagtggaaatctagttacctgtttatttgggtagctaat

SEQ ID NO: 384462 - DNA, 477 bp, Homo sapiens
tgtgcctcattcatcatcttctattcattgaagtctcatgaattttaagttgaatttgattataacacaaaatcacccatttctgtttaatgttctgttgatcatataactttaatgcctattcaatacctcaaaaagagagaatagtaatgtagttataatattgctgttagtgggttttgacactgagtaacagatgacatgtctaatgaatagtgtgactgcttagattgcataattataggtttgtttgactttaggaaaatcatacgcaggccaacttcacccatttagagactttttgtattatgtaaatattagagcacttcactctaaaaagaaaccccctccttcagtgataatcattctttgtttttccagggtttgccactcagtaggaaaaagcaaaatgaaatagaaaccatctttaaaggatggatttaattcagtagcccttcctggtttgaataacacttc

SEQ ID NO: 384463 - DNA, 272 bp, Homo sapiens
gaagagcaaaggcgggctcttacatggctgctggcaagggcttgttcaggggaccgcccatttataaaaccgtcagatctcgtgagaggtattcactaccatgagaacagcatgggggagccgcccccatgattcaattctctccgcctgggccagcccttgacacgtggggattattacaattcaaggtgagatttgggtatggacacagccaaatcataccaatgagctagagctggctactcacctccaccaaaaccgtttgcattttc

SEQ ID NO: 384464 - DNA, 2321 bp, Homo sapiens
  misc_feature (768)..(768): n is a, c, g, or t
cttaatatggcttagaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagccatactacctttatcactttttttttttttttggtgcaaagcttaacattctgcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttatttggtttggtttgatttttcgtttttngcttttaaaattcaaagcaaaacaaaaattgaagataccattgagaatcagaattcaagatgacttgattctcactaagatcactgcgctttttaaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctaggttttaatctgattccttgtgatttattataatgtagcagcatacttataaaagtggtctgtgctgagtcagatagagagcccagcccattagaaacacatcataatttaagaatatgatgcagaatgcccttacacttatttgtgcccagcttcccaaaaagaaaattgttttgttaagaggaaggcagttaatttggctagaatccaaaaactcattcagcatggctgttttcccttatttcaaatgaaaaacttttctaatactaaaatatgtaatcctgctttgctttaaattcccatgtctgtcactcaacaggaggcatagtgattcttaaatatttacggaacatttggtgagttgtaaagagaagtattattgcattgtaggtttttgcattgatgtgtcgatttttttgttttgtcccaagatttccttccagcaccttaatgaatgttcatatgatagaatgttttaagtatcagcaaagcattcatggatgcctgcttttcattctcagaaggctaaacctgttttgggtatgatgctacttcagaacatattgtctggcacaagatttcttctaataagtggtttatttaaactcaatttcggtggactgttgaattgaaaaacaccaaaggagtcttcttgtctggagactggattgttccagttttaaatacctgtgcccataagtatcccatttcatgaatgtgtgttggcatggggaaaaaatttccctgctctttgagtggagcgaaagcaattggttaagctgtagcagcttttttgtttatttttttaaagtaataataaaacttgaactgaaaaaagataaaacttgaactagaatactactcttgtatgcttagaatgtttatagtgttaaatgtttatgtggggttgtcaacatttttattatttatagttgaattatgttttgttaaatccatattgtttattatttttatattttgaaaatttttaaaataaaagtcttactaaaaacaaaaaaaaac

SEQ ID NO: 384465 - DNA, 1381 bp, Homo sapiens
  misc_feature (768)..(768): n is a, c, g, or t
cttaatatggcttagaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagccatactacctttatcactttttttttttttttggtgcaaagcttaacattctgcaaactttttttccccttgagtatgcattgcatttgtcatgaagagtaaaaagaatgtaataaacacatcagtcataatgtaaattaactgttttgatccacattggttggatacagcatggttaattctaggcttggttaaaaatacataatttggaaagtcttctaatattttaaagacctagtagtttacaaggcctttttttgttgttgttgttagacttttggttcacatttacaaactagccacagggtgttcataaatatttccccaaattagttgagtatttttaattgtaaacaaagaattttctgcccctactacactggtttactgctagggtaaagaccattgtctgaagacactaaacttggtgttaacagtgttgattgtttaatggatatggactacatgccactacctgcaactttgtcatcctggagtttttatttggtttggtttgatttttcgtttttngcttttaaaattcaaagcaaaacaaaaattgaagataccattgagaatcagaattcaagatgacttgattctcactaagatcactgcgctttttaaaaattgctttgagatctagtcagttacatatttaaaatccccgtgttgattagagataaggttttcattattttattttcctaaataggattctcatggagctattgtagataactgtacagaatcacttttgtgtaattgaatgaagcagtttcctctgcatgattgcataatgaaagccttttatatatctatatttttcaatacttagattttacactattaagctgctctagtcatgctatatttgtttttttaatagagtttataaatatttatgctcaaaatacagatcaactgaatatttttggtcttgtttacaagataaatcatactttaaaatgatacaggcccctcaagtgtcttaggaaaaagtcattggtgctataaaacctttcagtatcatttttgaacccattgttcagactttgctgggctctctatctgactcagcacagaccacttttataagtatgctgctacattataataaatcacaaggaatcagattaaaacc

SEQ ID NO: 384466 - DNA, 493 bp, Homo sapiens
gtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatccagctctatccacccctacagcttccccggccaaccaggttcaaagcccatcagttatatctcactgtgccgctgtcaatgcatgttgtggctgctggcaaagagttggtttg

SEQ ID NO: 384467 - DNA, 575 bp, Homo sapiens
acaattctcatgcctcagcccccctgagtagctgggactacaagtgcgtgccaccatgcccagctaatttatgtatttttagtagagatggggtttcactgtattgcccagactggtcttgaactcctgtgagctctagtttcattaatgttattcacttgttgagtctctggttctagattaaccaagttgttatcttttctttctttcttttcttttatcacagcagatgctactcaggcaagagaagggccttctcgggaaacttctccccgggaagcccctgcatctggctgggcagccctaggtctttcctacaaagtacagtggccactacatattctcttcaccccagctgtcctggaaaagtgagtatttctgagtttctcacaggtaaatatgacccaccttacttgtaagggaagaaactagcaggaacagaattagtgggaaagcaaggtgtggtggcacacacctgtaatcccagctagtccagagcctgagcaggaggatcccttaagcccaggatttcaaatccatcctgggcaacatagtaagacccccatctcataaaa

SEQ ID NO: 384468 - DNA, 2395 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtg

SEQ ID NO: 384469 - DNA, 3545 bp, Homo sapiens
tcatcattaaatatttattgagtgcttactgtatgcaaggcactggggatacaaagaggtataattcatggctctgcccttaaggagctcacaatctagttggaaaaacaagacatatatatatatatacatacaaaaatcagtaacaacacagaggcctgaacaattgccaagtggacaacagtacagataataaagaagcaagaaacgagggttcactaaaggctatagtggggaagggagtgcttcactgagagagtgggacttgaactggtattaaaaacaagagcatcccgggcaaagggaacaacactcacagctcagaggcaggaagacactctgcgggtctaagaaatgaagagttaaatgtggctagattggaggtttggtgcagggctaagagagtaatactcgcttagccaggaaaggatgcatttgttttacgcattttgtgcgtctgaggggctggcaggccttgcacgtggcagtgtctatcctgtcagatttgggaggtcagctattaattagatcagctattaatcagactgttctcctaacactttaacttcatggatgtaccttccttcctttcctaatgccaactctgtttcccgggtaggtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagaggtggttttgccaatggagaattcatgatctttcctctgagtcagtaaagcatttcctcaatacacacacgtacagagataagatacaaagataaaaatgttggtatcagttgattttgaagcaggtaatactgtgccacctcacagtgctcaaaaatagttcagtcctgaatagtttattcagcccatcaaataagcattgggttgttctaacttcctcacatcctcccccctccttacttccttgaactaacccccatctcactgagataattatctgcttgtaatcaaaacgggttctccccaaccccagtacttgacaaaatacattaactggaaaccagctactaaattcctactgatgaaagagtactttcataggaagtcatgcatgtatggatttggtacaagtcattttaggaactaatagaaataggaatgtgggaaggccaggtggttctgtagaattttgaacaaggcttttccaagaaactcctccctccgcccccatcctccatatggagagttggtgagctgaagtggaatgacagctgagtccttctctctgcagggctttagccgccagtcttcactcctgttcaagattctctccagtgttcggaatcatcagatcaactcagatttggctcaactactgttacgactagattataacaaatactatacccaggctggtggaactctgggcaggtaggagcaacccttgggtaactcagtagactttttaaggtggctttttaatgagttgtagaattctagaactggaagaagactttagtccaaataccctcattttataagtaaggcttagagatagaggtgtgaccatctttaataattttaatggaggttattttctagtagaagtcatcatcatcataaaatactaaaaaacctgacagtgagataggtgttaagtcctttgctaggttatgtattgctatgctgggaggcagtgggccttccactcccaattctgatatgaactagctgtgcagccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaacct

SEQ ID NO: 384470 - DNA, 2458 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaaaaatagacaattttaaaaaccaaacagaatgggactgtcttctgcaagcctacctacaaacaggtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtg

SEQ ID NO: 384471 - DNA, 3725 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaacct

SEQ ID NO: 384472 - DNA, 3453 bp, Homo sapiens
tcgcgaaaccaatacgggcaggtagcgaggcctgggtggttgtgacaatcgagtatcacggaaaggagcacacagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaaggtgcgtctgcctggaagtatgcagccttgccgaaaggacagaggtggttttgccaatggagaattcatgatctttcctctgagtcagtaaagcatttcctcaatacacacacgtacagagataagatacaaagataaaaatgttggtatcagttgattttgaagcaggtaatactgtgccacctcacagtgctcaaaaatagttcagtcctgaatagtttattcagcccatcaaataagcattgggttgttctaacttcctcacatcctcccccctccttacttccttgaactaacccccatctcactgagataattatctgcttgtaatcaaaacgggttctccccaaccccagtacttgacaaaatacattaactggaaaccagctactaaattcctactgatgaaagagtactttcataggaagtcatgcatgtatggatttggtacaagtcattttaggaactaatagaaataggaatgtgggaaggccaggtggttctgtagaattttgaacaaggcttttccaagaaactcctccctccgcccccatcctccatatggagagttggtgagctgaagtggaatgacagctgagtccttctctctgcagggctttagccgccagtcttcactcctgttcaagattctctccagtgttcggaatcatcagatcaactcagatttggctcaactactgttacgactagattataacaaatactatacccaggctggtggaactctgggcaggtaggagcaacccttgggtaactcagtagactttttaaggtggctttttaatgagttgtagaattctagaactggaagaagactttagtccaaataccctcattttataagtaaggcttagagatagaggtgtgaccatctttaataattttaatggaggttattttctagtagaagtcatcatcatcataaaatactaaaaaacctgacagtgagataggtgttaagtcctttgctaggttatgtattgctatgctgggaggcagtgggccttccactcccaattctgatatgaactagctgtgcagccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaacct

SEQ ID NO: 384473 - DNA, 2795 bp, Homo sapiens
tcatcattaaatatttattgagtgcttactgtatgcaaggcactggggatacaaagaggtataattcatggctctgcccttaaggagctcacaatctagttggaaaaacaagacatatatatatatatacatacaaaaatcagtaacaacacagaggcctgaacaattgccaaagtgctcaaaaatagttcagtcctgaatagtttattcagcccatcaaataagcattgggttgttctaacttcctcacatcctcccccctccttacttccttgaactaacccccatctcactgagataattatctgcttgtaatcaaaacgggttctccccaaccccagtacttgacaaaatacattaactggaaaccagctactaaattcctactgatgaaagagtactttcataggaagtcatgcatgtatggatttggtacaagtcattttaggaactaatagaaataggaatgtgggaaggccaggtggttctgtagaattttgaacaaggcttttccaagaaactcctccctccgcccccatcctccatatggagagttggtgagctgaagtggaatgacagctgagtccttctctctgcagggctttagccgccagtcttcactcctgttcaagattctctccagtgttcggaatcatcagatcaactcagatttggctcaactactgttacgactagattataacaaatactatacccaggctggtggaactctgggcaggtaggagcaacccttgggtaactcagtagactttttaaggtggctttttaatgagttgtagaattctagaactggaagaagactttagtccaaataccctcattttataagtaaggcttagagatagaggtgtgaccatctttaataattttaatggaggttattttctagtagaagtcatcatcatcataaaatactaaaaaacctgacagtgagataggtgttaagtcctttgctaggttatgtattgctatgctgggaggcagtgggccttccactcccaattctgatatgaactagctgtgcagccgtgggcaccccgccttgctggtccctagcttccgcatctgtgaaaggaggcgaccaccccttctaactctaaactttaaaaaaaactgataccgagattcagtggtagctggcttcccagaggtctgtcattcccattcagaaaatcacttcattgtcctttctctctaaaatgtctgcaagcagatttttttctaagctattgtagcagaagagtcaaagaaactcttcagttttaagatgacattatttagatcacaggttatcctgattcatatttctttgaaggtagtcttgggaaagcatgacacttaataaggctctttttctcttttgtagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaacct

SEQ ID NO: 384474 - DNA, 366 bp, Homo sapiens
cttgaatatcctgttatttctgtcctaggtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtctgtgctaagagatgagtagaaggaaggggtacggaaaaacgtctaggaggttggcagggagtattgaatagggactacaagtttctatttgataaaatggtggggtttgggaaaattcaggagttatatcaccaagcatgtttcttaaaataaaaaa

SEQ ID NO: 384475 - DNA, 3682 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtacaatgttgtttttaagtacttactgagtgtgcgccgggtgcaagctgagctgcagcactgctgggccctacaaatgcagcgcaagcacctcaagtcgaaccagactgatgcaatcaagtggcgcctaagaaatcacatggcatttttggtggataatcttcagtactatctccaggtagatgtgttggagtctcagttctcccagctgcttcatcagatcaattctacccgagactttgaaagcatccgattggctcatgaccacttcctgagcaatttgctggctcaatcctttatcctattgaaacctgtgtttcactgcctgaatgaaatcctagatctctgtcacagtttttgttcgctggtcagtcagaacctaggcccactggatgagcgtggagccgcccagctgagcattctcgtgaagggctttagccgccagtcttcactcctgttcaagattctctccagtgttcggaatcatcagatcaactcagatttggctcaactactgttacgactagattataacaaatactatacccaggctggtggaactctgggcagtttcgggatgtgaaaatttctggctcataaattgaaataacagccacgttcccaaggttgtaacagaagattcaaaacatcccattctagccacacacaaataaatatctgcggcttagtgataggactctaccttttctcctagaagcagttactgaacatccaggagtacaactccttcccatcattcccatgtggaagggtctctcccatcaaggagaacatgtggcatctctgatcctttacattgagaacatttgttggatatgttcatttattcaatagtcatttattgagcacctactacgtaccttggtactgttcaagctgtgggagatacagcggtaaacaaacaatatagagcagaaagttaaatattttatggttcatatgtgaaaaagtaattatgtttataaatagactaactgctggatgttaccaccaagtaagaaagcaacaggtaagataggctttctctctccctataccaagtaatttatacctacacagattgggcaattctagctaatgaaaatatacttaaaagtatttcttaggccgggcatggtggctcacacctgtaatcccagcactttgggaggccgaggcgggcggatcacctgaagtcaggagtttgagaccagcctgaccaacatgatgaaacctcgattctactaaaaatacaaaaattagccaggtgtggtggcatgtgcctgtaatcccagctactcaggaggctgagacaggagaattgcttgaacctgggaagcagacgctgcagtgagctgagattgtgccattgcattccagcccgggcaacaagagcgaaattccgtctcaaaaaaaaaaaaaaaaaaaaaaaagtattattctccaagaaaaaggtccttaagaaaaaattgagatcaagttgttagatttttaaatactgaagattgcaggcccaattacccatcttacacaaaccataggggttgaagttatcttaatatggcccagccatcactggtaatcaatattcatatcagtgtaagtaaaaagaaatattcactgaacaacgccctccaaactgaaaaagaatgcagtgttctggcatcaggttatagtcactgcatctggttttcatcactacatattctacacacactgggaagctctgacaacttattccctgctattatcaactaaagatcaccctttccactgctgtctctggagcaggagctggcaaactatggcctgctgtctgtttttgtacagttttactgaaacacagccgtgcccatttgtttactcattgtctatggttgctttcatgccctcacagcaaaggcgagtagttgtgatggatcaaatggcccacaaagcctgaaatatttactctttgaccctttacagaaaaaaacct

SEQ ID NO: 384476 - DNA, 1077 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggtgggtcctgttctctgtgggtgtacacctctagagggcaggagctatgtcaagctttcacctctagagggcaggagctatgtcaagctttcagtgaatttatcggtaattcatgtgaaataagttatggatttctcatcactagaaatattcaagtgaaggcaaggcctctaattggtttgtttgtataacttttaaaagaaacaagcctgataatgtctttctcaggtttcagggcctgagctgagaagttggcttctgtttgtttgatttcaggatcaccatccatctcaacagggccaaggtgggttacatggaatctacctgcgggccttctgcacagggctggattctgttttgcagccttatcgccaagcactgcttgatttggaacaagaggtaagaaggaggagatataggaaacacctctgggacagtagattagggcatgttcttgaatctgaaatgccctttgataagatcaggtagttaagagtgagcagttgcctgcatggctggaaggtacagtgttctctcagtgattgcccaacctgtgatcagagtggcttacagatcatggcaaagac

SEQ ID NO: 384477 - DNA, 1911 bp, Homo sapiens
  misc_feature (1)..(1): n is a, c, g, or t
  misc_feature (8)..(8): n is a, c, g, or t
  misc_feature (10)..(11): n is a, c, g, or t
  misc_feature (15)..(17): n is a, c, g, or t
  misc_feature (19)..(22): n is a, c, g, or t
  misc_feature (24)..(24): n is a, c, g, or t
ngcatcgngnnggcnnngnnnncnactggagtctccgcagagcccgggcgggagtagctggtggaccccgttgagctgccgaacttccgggactcccccgcgaccccttcccagcttcccgtccgctccgccgcagcgattgtctcggtgggttgattcggcacaaaccgcccgacccaggggccggtgcgcgtgtggaaggggaagcactcccctcgtggtcgcctggaggtgcgctggaggagggggtgacataaccagggactcgaggtccgccgtgggaatgatccacgaactgctcttggctctgagcgggtaccctgggtccattttcacctggaacaagcggagtggcctgcaggtatcgcaggacttccctttcctccaccccagtgagaccagtgtcctgaatcgactctgccggctcggcacagactatattcgcttcactgagttcattgaacagtacacgggccatgtgcaacagcaggatcaccatccatctcaacagggccaaggtgggttacatggaatctacctgcgggccttctgcacagggctggattctgttttgcagccttatcgccaagcactgcttgatttggaacaagagttcctgggtgatccccatctctccatatcacatgtcaactacttcctagaccagttccagcttctttttccctctgtgatggttgtagtagaacaaattaaaagtcaaaagattcatggttgtcaaatcctggaaacagtctacaaacacagctgtggggggttgcctcctgttcgaagtgcactggaaaaaatcctggccgtttgtcatggggtcatgtataaacagctctcagcctggatgctccatggactcctcttggaccagcatgaagaattctttatcaaacaggggccatcttctggtaatgtcagtgcccagccagaagaggacgaggaggatctgggcattgggggactgacaggaaaacaactgagagaactgcaggacttgcgcctgattgaggaagagaacatgctggcaccatctctgaagcagttttccctacgagtggagattttgccatcctacattccagtgagggttgctgaaaaaatcctatttgttggagaatctgtccagatgtttgagaatcaaaatgtgaacctgactagaaaaggatccattttgaaaaaccaggaagacacttttgctgcagagctgcaccgtctcaagcagcagccactcttcagcttggtggactttgaacaggtggtggatcgcattcgcagcactgtggctgagcatctctggaagttgatggtagaagaatccgatttactgggtcagctgaagatcattaaagacttttaccttctgggacgtggagaactgtttcaggccttcattgacacagctcaacacatgttgaaaacaccacccactgcagtaactgagcatgatgtgaatgtggcctttcaacagtcagcacacaaggtattgctagatgatgacaaccttctccctctgttgcacttgacaatcgagtatcacggaaaggagcacaaagcagatgctactcaggcaagagaagggccttctcgggaaacttctccccgggaagcccctgcatctggctgggcagccctaggtctttcctacaaagtacagtggccactacatattctcttcaccccagctgtcctggaaaagtgagtatttctgagtttctcacaggtaaatatgacccaccttacttgtaagggaagaaactagcaggaacagaattagtgggaaagcaaggtgtggtggcacacacctgtaatcccagctagtccagagcctgagcaggaggatcccttaagcccaggatttcaaatccatcctgggcaacatagtaagacccccatctcataaaa

SEQ ID NO: 384478 - DNA, 212 bp, Homo sapiens
ctggaagttgatggtagaagaatccgatttactgggtcagctgaaggtaatggcttagctgttgtaattcttacggtgatgctggtaggcagtgacttgcattctctgatgtttcctgagagcactggttgcctatacccagacttccagagtcaactcatttgttcttatccaagtgagcaaactatacctaatgccacaaatctacgata

SEQ ID NO: 384479 - DNA, 1260 bp, Homo sapiens
ggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcc

SEQ ID NO: 384480 - DNA, 434 bp, Homo sapiens
tagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaa

SEQ ID NO: 384481 - DNA, 596 bp, Homo sapiens
ttggctgctgttatgaatgggaggaatttctttttatagggcttaaatttcttgatacaatgatataggcaagattcttttcaagtttatcccagctcacattgtataattaaataaagtagaaatgcattaacatggcagtaataaatacaattctctttccccatgttgcatacaagatcatataatgtctacttggttagttatttaaactgatcacagagtttgtggtagtgtttgcctaatgttactatatggtataataaatttaaagtaaatttcaagttgaatttaccagtgaaaggactcaaaaattactgaggttgcaaaatttcatttctgtaacacttcgctgtatacttttgcttacagtaaatgtttttgccatgagtatattacatataatcaatgtaggtaactttgcaactgcaataaaactttacaattacttatcactaagaaataatatgttagagcctgtgaatacaaaagccaaatgccttgcctttactattttggattacctttttttttttttaaggatttaaataagcggttatcactgcctgcagacatcagaatacctgatggatatc

SEQ ID NO: 384482 - DNA, 2303 bp, Homo sapiens
agggggcgctgcccccggcgagccgctcaggcgggggtggggtaagctcccgcggccggtcgcttttctccgccgccgctggttggatcgtttcaataaaagtgttttttctcttgcactcgctctcctccggggaacaggcggaggcgtcaatccgcagccgccgagtgtgaaagcgacgcacacgcaaggagcgaacgcggccgcccgcagtctcctgagctccccgcgggccgccgcagagccgcggagaaggagccagcgcccggccagacagtctcagcccgccgtcggcgcccgccgcgctcgcgcccggctgctccgaggggattagtgggccgtccgcgcggctcgtcggcgcgggagccatgttgaccgagggacttggcaacgcgtgagacacccgcggcccctcccgaggctccggacccgcggcgagagccggaaggcggctgtggcggcggaggcctgcgctcggaagcgcctcacgtctgccggccgctgagacccggacttgcatccggtcgccgcgggcgtccgcggagcagcttccccccgcgcctctcttcgcctcgcctcgggacccgcggtccccgctcttgctggatttttcaagccacattcaattgataggatgaaaaaatttaagagaaggctatccctcacactccgaggaagtcagactattgatgaatcattgtctgaattggctgaacaaatgactattgaagaaaacagcagcaaggataatgagcctattgtgaagaatggcaggcctccaacgtctcacagtatgcattccttcctccaccagtacacaggatctttcaagaagcccccattgcggagaccacacagtgttattggagggagccttggctccttcatggcaatgcccagaaatggaagcagattagatattgttcatgaaaatctaaaaatgggatcagatggtgagagtgaccaagcttctgggacatcatctgatgaagtccagtcacctacaggtgtttgtctcagaaatcgtatacatagacggatctcaatggaggatttaaataagcggttatcactgcctgcagacatcagaatacctgatggatatcttgaaaagttgcagataaacagtccaccatttgaccaaccaatgagtcgaaggtctcgtagagcttccttatcagaaattggctttggaaaaatggaaacctacatcaaattggaaaagcttggagagggtacatatgcaacagtatataaaggaagaagtaaattgacagagaatttggtggcattaaaagagatccgattggaacatgaagaaggtgcaccctgcacagctataagagaagtttcactattaaaggatttaaaacatgcaaatatagtaaccttacatgacattgttcacacagataaatccttgactttggtgtttgagtatctggataaagacctgaaacagtacatggatgactgtggaaacatcatgagtatgcacaacgtaaagctgtttctgtaccaaattctacgtggtttggcatattgccatagaagaaaggtattgcatcgagacttgaaaccacagaacctcctcattaatgagaaaggagaattaaagctagcagattttggactagcccgagccaagtcagttcccacaaagacctactcaaatgaagttgtcacactatggtaccggccacctgatgtgcttcttggttcctcggagtacttaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccagagcctctaattaaccacgcacccaggttagactctgaaggaattgagttgataagaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatct

SEQ ID NO: 384483 - DNA, 463 bp, Homo sapiens
cctcgtctctaaaaacaaacatggaaaataaaacttatgacttatttatttctggaattttccatttaatattttcagactgcagttgactgcgggtaactgaaaccatgggtatgggggttggctgtgtttgtggtcaccagtttacagtcccttgctgtagaacagaagaataggctgtgaatctagacgaatgttttccaatcactacctctgacattgggaaggttatgcagttttgccttctgtaaaatgagaaagacattacttaggtcatggacttgctggtttaacagtgataaatctggctgggcatggtggctcatgcctataatcccagcacgttgggaggccaaggtaggaggattgcttgagcttaggacttccagaccagcctgggtaacataacaagacctcagaacaaaaacaaaagacatctcagaaaaaaaaacaaaagaaagaa

SEQ ID NO: 384484 - DNA, 443 bp, Homo sapiens
gagtgaacttcccagagcacttttgtctgggcctctgtgccagtgtaaactgataatagtgatttccctgccccacctctctgccagctatctaagttttctttgttacataatcaggattaatttaagcagcctaggccatccatttagaaatggttagtgaagaaaggtgaatggggaggggtcagagtcccttagggggccaccaggtgcgagtccccttgctctttggggccttggtttcccttctgtgagttggggcagttgaagggaagggctgctcaggtggtcctgccacatcccagtgttgtgtctagtgagtacaggtgagagtgctcccaaccagggcagatcctgctgctaggcagtgagtcaggaaggaattggtaaaaatgacgtcattgctaagaatgacgtcttttttgctgtttatccaaaggaaa

SEQ ID NO: 384485 - DNA, 631 bp, Homo sapiens
gccattgttctgaggtcacaagatttgcaacctccacagttgcccctgtaattaacatcactattgtagaacctaagattggtcttttgagacgttttagcagacttttgcattcaggcaactgactgaccacacctgggcttgcaacttgtgactcaacaggccctgtggccccacccagagggggactcagccaccaggactgttttccacacccctatgagtccatccccaaccgatcaacattccctatttcctagccctctgcccaccaaactatccttgagtattaactccctcttctgcgtggtcggcctcacatcagttacactccctttgctgcaaagctatggcctcagtgaattgatttttgtttgtgctgacagcaggagaaagccactgggcaattacaaaacagcattcattatctcccctagtttctgtgggtctgggctccaggagcagctcagctgaatggttctggctcgaggtctgtcatgaggctgcaggattcactcccagctggctcatggagctactggcaatgaggctccagttccttggcacgtggtcctccctggtgcactaacatggtttcagctagagcaagacagaagacagggatagagaa

SEQ ID NO: 384486 - DNA, 388 bp, Homo sapiens
tggctcatgcctgtaatcccagcactttgggaggttgaggtgggagggttgcttgaggtcaggagttcaaaaccagccttggcaatattgcaagacccctgtctctacaaaaaataaaataaaaattagctgggcatgtgggtgaatacctgtagtgctagctacttgggaggatctcttgagcacaggagtttgaggctgcagtgtactgtaactataccactgcactctagttgagatgacagagggagaccctgtttcttaaaaaagaaaagaaaaagctgcctttggaaactaatcctacttttctgacctcttctgataggtctactgtaaaaaaccaaagtcaactttgaataaacttgacaagctgaaggagaactttagg

SEQ ID NO: 384487 - DNA, 326 bp, Homo sapiens
ggaactccctgacctcagtgatccgcccacctaggcctcccaaagtgctgggatctattataggcatgagccaccacgcccagcccaaagtttttactttggatgtagttcaatttatctattcttttgctgcctgcaagaggtaattctttatttggtattggaacttgttactcaggaatgtgttcttttgaccgggtacagtggctcatgcctgtaatcccaatacttcaggaggctgaggtgggaaaatcatttgatgccaggaacttgagaccagcctgggtaatatagtgagaccttgtctctgaaaaataaaaagaaaa

SEQ ID NO: 384488 - DNA, 409 bp, Homo sapiens
gattttccaagtgacaaagagggcttccttctggagccaattttaagaataggatgctgggcaactgtgaagcgagaagacagtctgggagtagagagcaagcaacattttataacagtacatgaatacccattctaggaaagagtttcctcttctaattttgagtcaaacatgtgactaatcagcatataaagctgacacatgaggtcccagtgaagattgtcgatggccgtgtacattacccataatgtcagctgggactggaaactaagtcacatcacatttaggaattgtgtctaagttctgtcattagttagacacatcacttcagaaagtcgatctttctttgtacgtcaattatgtcatctctaaaataaaaaatttgagttagatgagctttcaatcccta

SEQ ID NO: 384489 - DNA, 347 bp, Homo sapiens
gatgtgcacatgctattgccctgctgactattttaaatggatgataattgggaataatgaccgggtcagaggtagggatgcgtaaaccctggcagagcagccttccaccaagtcaaagcacatggggccctcagagccgggagccggcacttgtaagctgaattgagcacacaatgtatgtggctggccacatacgttgccaaataaatatcacattacacatcccatctcccccacgtgaccttggtgtagacaaagtctaaactcatctaggagatgagaacatttttgttccgagaatgatcccatctgcctcccccaactcccaaatatccttcaacccctct

SEQ ID NO: 384490 - DNA, 1370 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaataga

SEQ ID NO: 384491 - DNA, 656 bp, Homo sapiens
aactccaaagggtagaggcctctagagaagataaaaagatcaggagcaggcatggtaggccatcaggagtgcatcatggaagaggacaatcgcgctccccaattgtggcgcaagaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttcgcacacatcgtacgagcaagcaactctgttgtggggagacacgaagaggacaagatgcgtgtggacgttaggaggaacgcagggaatggataaccacactggatgctggtcgatgacatgctgctatgacctcgagatctgagagatactgaagcctcaatacttggtaggatactctcctgcaaaagtctaaagctcatactcaggagtgacactgtgggaacagcggggctatggtgtgagcaaggcacgacaaagtagtccacctgttgggggcctttgcacttagcccttactgaattgtcccttgtgaacatgcaaaccggtagtatgtgtagccccaaagctgctaaggagcgccctgggcatagaacttggaagggagtcccatcatc

SEQ ID NO: 384492 - DNA, 2008 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaacaaaaaaaaaaaaaaaaaaacaaaaaacaaaaaaaaagggggggggcggcaaaaaagattccccggggggggcccaaggaaacggggaacacaagaattcaggtggcaacaagggggcccacataaggagcacgagattacaacaaatagagaaggggcgcgaagatcaaaaaaggacgagacggggaaacctgtcaaagggggaccaggggaagaaccaaaatttaaggggggggggcgacaaaaataggtgggggcacacatactaagaagagaattttaaagcctcaagggggaacaatatacaatttataagggttaatagggggtaaaaaaaaggaaatatacacgagatgtaaaatgggctagggagatgcattagacaatttca

SEQ ID NO: 384493 - DNA, 1129 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggagcggctgttccctcaacctgctacttctgcgtccataagggtcctgcacgttgcctcccaccaccccagctctgccagaataaaattgtttccaataga

SEQ ID NO: 384494 - DNA, 1695 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaataga

SEQ ID NO: 384495 - DNA, 1616 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaataga

SEQ ID NO: 384496 - DNA, 1907 bp, Homo sapiens
cagaaagaaggggagaagaagcggggggatgggtggagggtagaggggagaaaaatacgtgacaaagaaaacattctctgcctgggaggagactctctgagggtgtagagctagagggagcattcactggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagctcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaatagaggtggcaaagtgcttctgaaatagtcgagaaaaagacagattccaacctcctcagtccagccactgagacctgatgttggaacgcatcagctccttccagttccatgaatgtggctcatagacaaagccttgctttaggctggttataaaaggtcatctagtgtgaaccttaactttttattcaaaggacagttttgtcaagaactccacgtaaggcctgatgtgctcctggttgtactttctcatcactggtttgacttcattgttttgcagaaattaccttaatccgtg

SEQ ID NO: 384497 - DNA, 892 bp, Homo sapiens
cagttcagaggaccatctgacatcgatgtttatcggggaccacgttctgctgcctgccaggccgctttatgatatgcctcccctccactctcccaaactgagcccttccttccatgaggcccccatcccgaggaactaggcccttgctgctgcatctgagcatgtgtgcttgccaaagcttggagaagcagctggtggcagacagaccagagggactggacttcctgtgtacctctaacagggagtggggatagccgcagctgctctggatgctgtgctgattagagctcaccaaaggacccagggatgccatcatgagctctctgcactcttggcatttgagaaagggagtgagaagaagggaggaggaagaaggagggtgggagagggcaggagagacagagcagcctcctagttatttcttggaatgcatctgggcagtgaccctcagcgaagagagaggcaggctttcagacctaatgcaataaaagaagagtggtcagtaggcccagttctcagcactccatgcatgttaactccattaccaagtactatgattatccccattgtactgatggggagaccaaaacaaagagaaatgaagcaatttgcctagggtcacacagctggaatgcagcagagtcaagatttgaacccaagcagatggccgtcagcatctttacaaccagctgctgtgggatggagctgggatttgaacctgtgttcatcagagtcctgaaggcttatgcttaactactacagagtcccatgtccctgtgatgtctgcctcagctttctcccaagggtctggggaggaagtgtccacggcgctcggggttgtctgtttctagccccgccccagctggttatttctcactctgctggggagcac

SEQ ID NO: 384498 - DNA, 568 bp, Homo sapiens
aaaaaaaaaaaaaagaaaaaaaaaaagaaagaatgatgggagtggtgttgacgtatgttagcattccttgtcttgcccctttagcaagtttcctatatcaataggagaaacaaacagcagaatcagtagctgaaatgatatgcagtgtgatgaggagagttgtagttagagaccttttaaaaaaacaaaaaaaaaattacaaagtagacaacagccagatgcttctggtcatattcaattaacactgaaggatttctagaaaaacagtccttgagatacctaaggaaatctgagagaaactgcctgaaggaacaaagaaagaacttgtggtgcagtaataccaagccattgttcttgaaaaagagccaaatttcttccctgagaccataaagttgtgaacagaatagatacagttctttcccaaggagagaagaaatgagtcacatgtctgcaacatattgatgaggcattagcgctccatctttctcataattgccactgcctgtaataggtttcatataccaacatacatatgtctgtcttatgaatgagacagagggatatcagt

SEQ ID NO: 384499 - DNA, 1154 bp, Homo sapiens
  misc_feature (954)..(954): n is a, c, g, or t
catgagaccatcttgcatcttcctaagtggacagggaagagcaagtccccaggggagccacccgggaaagtgtggcaggaagatgctcagagctgaatggcagagagactcatgggcctgctctccatgattaaagaagagggatggatctcccaggagagggccaggaggccgcctgaggcagcttctgtgaggaacaggtcgatgtaagaagacttgacaaggagttgaaattaggtgaaagcaaagaaagaaaacaagagaggcagtttcctgctgcatattttatttgtgtgcataaccccaaggcagtggcagggaagtctaataaatgaggcaaaataaaagagcttcaccttttaaaaaaagaagatcgttgccaaaatgtgtcaattccagttttaaaaatcacatgaagccctgactctgtgcctggcaccaagttaagtcctctatggggagtttgtgtttaaatggagtggacagatgcaaacaagatggagcggtaaggccactgccattatcaaggtgcgaattaaggtctgagcaccccagaagatggagcggtcctgatggaagatgcctcagcacataccttgcttggaaaaaggacccctctggaaagactgcagggtcgtatcagcatttgacagaacctatgtggtcgtctctgcctgccctgcctgccctccctctctatcccgcattctccctgcactgcagccatctggagccacaggcagctgccccctgccccacacgcacaaacacacacacacacacacatacacacataaatacacacacacacacacgcttcatgggtctcagcctttggcatgtgctatttcccctcttgcaacaaccacccttattcatcccatttgaggtgtggcttctcatcttcaaaaagtcagctcatactgcatcttgagactttcttagaaacagccncgccctctgggctcccacagccccctagattaactcctagtgtatccccacccccaccccattacaatggccatggttggtcagtcctcctaacatcagggactgcttcaaagacaagaaccttgtttctatcacctgtatccaaacacacagcctgacagtgggtcagcactcaataaatgcttgtatttttcatgaat

SEQ ID NO: 384500 - DNA, 292 bp, Homo sapiens
gaatgaaaaagtgctgaaagaaaaaactcaaggaagaattctctctctggcaaaactatctttcaaaaatgaaggataaattaagacattcacagataaaatctgagaacattcactgccagtagacctgctctcacaagaaatgctaatgggagtccttgggggctgaaatgagaggacactggacagcaaattgaagccatatgaagaaataaagatctctagtaaagataactgcatagattaatataaaaacagtattgttgcatttttggtttgtaactatttccta

SEQ ID NO: 384501 - DNA, 398 bp, Homo sapiens
tgtcacagactgcagaaagctcaagtaagaggagcactgaataatatccattaaatttgaagcctttatatcttttttcccaagaagcaacagtctcatggctggtgtacaactgcttcagaaaatagtttagcattagcagggaagctgaacaggtgcagacctcaacatccagcaactccactcttacgaatatgtggatgcttgctactcagactgtggtccacagacagacagcatcagcatcagcaggaacttgtagaaatgcagaatctggccaggcacggtggctcaacgcctgtaatcccagcactttgggagactgcagtgggcggatcgcttgagcccaggagttagagaccagccttggcaacgtagtgacccggtctcaaattgga

SEQ ID NO: 384502 - DNA, 188 bp, Homo sapiens
tctcccctaaggtgtgaggggtgggagctggggtgggtaatgggggtattgaaagtgctaaccctctaatcacatagttgttcctctagcaactagcactgtccaatccggaagctatgtaagggcccaccaagtcaccttattaccgtaaactgaggtagatttgaaggggcttattttaaataaca

SEQ ID NO: 384503 - DNA, 353 bp, Homo sapiens
tagaaacattctaatgaaaagtctagaactaagaagttataataacaaattaaaaactcagtggatgaatttaaccgcttgttaggtatagccagagagattttgtaaagtggaaattagataaatcaaataaaatatctgaaaatactgaagcatgcagagacaaaatatagaaaaagaacacacacacacacacaaaagacagagaggtgaaaagtggagaagaaacaatatttgaaaagataatgactcaaaatttttcagaattgatgaaagacaattattcacatattcaataagtgctacaagccccttaaaggatagatgcaaccatgcctaggaacattatagta

SEQ ID NO: 384504 - DNA, 420 bp, Homo sapiens
cttctagggttactgattccatctcagtcacaatcccgatcacagcttcctttcattgagggcttgactgtccacaccttggtatagatacttctatacaatagcatagaaggaggatataactgaatccatagctattgtcatcccattttacagatgaggaaactgaggctcagagaggggaagtaacttacccaagactgcacagcagtaagcggcagaacctggacccagcccctggctccagacccccactgctctgctgacctgcaggggcctcgaatcaacataaagcctttcacccctagcctgctcctgtctcaacctcaacctccagagaacatccatcctccatggagcctcccagcctgagccctctgagctgcctcccttcttctctcccctcagcccaggcttccc

SEQ ID NO: 384505 - DNA, 692 bp, Homo sapiens
ctctgaaacagatccaagatgttgtttgagccatgcaactagaagatctcatagaactaaagttatctaatttacagaaaaggttttacgtgacgtctattgtacagattcatatgaaaaccatagttcaaactccaaggtttaagaagtaagaaagatcatgccatttgcaacaaacatgcatgcatatttgaaaagcaactgtaagtatgctattggacattggtaaagattgaatatctgaccatggcatatcaagaaaccatggaatgagtactgcttatcaagatctgggtgtgagaagacttaaaaagtcagatagtcagtgagaaccagctagaatccatgatctgttgtgggaaaactagaagaccaaaaaaagcacgaaagtcaagaaagaagtctcttttcacatgaaagtggcctgaagacaaatactgctatgaatggttacatctaggacttctgaaattagccccagattcaactcatttttttctgcatttgctgagcaatatgacatgtttacaccgattagctaaaaagttatgtgaagaatgggcaacaatatctctaaggcaagatatgttcagatccaatatagttcatatagaccttgtcagagtaaatgaccatgtgcctttcagaacactaaagaataaaatccttccacattagaatgacaaatatgt

SEQ ID NO: 384506 - DNA, 362 bp, Homo sapiens
ctcagattcattccgggaaagcttcgcagtggcctgggaagtgctacataatccaccccgagctcttcctctctcgtcaccactgtgccccctgctccctgcagacccagcatgatggcctctctgttcttcagcaagccaggtgggccctgcctcggcctctgatctccagggaacatttctcccccatacctgtgtggcggttgcccctctccttcaggtctgctcccacagggtgttttatagaaatggcttgaaacagacgcccttcctcagcccttgaccacgcaagctctgaggagccactggtgtccctgtggctttgctgcaaccagatctctctggtcaagggcagccctagg

SEQ ID NO: 384507 - DNA, 456 bp, Homo sapiens
agtgccaggctgccgcacgcggctgcatctggttgcccaaggttgatgtagccgcggtctctcgtcacgacatcgaagctcgggaaacggatggaagcagggctctagagaggcacgattgcatcgacacgtgggcaggtcgcccatgccaagggccatgttggtgggtgggtgcgtgggatctgtcgtatgagtgagtcaaagcctgattttttcccccaaaaagattgaaatgagatatcatattttaacattagttttatggcatcttgaatagcaacacattttagctcaaggaatttttcagctgtccttttgagaaacgtaaattttctttgtttttaagtatttaataagcattctttacaattgcaccacagcgcgaactttccacctgctttattaattatgacatttgtgtccccactattaaaatattccgcagtattataaaaa

SEQ ID NO: 384508 - DNA, 407 bp, Homo sapiens
aaagagacaggttgtcactctgtcacccaggctggagtacagtggtgtgatcatggctcactgtagccttgaacttctgggctcaagtgatacccccgccaccacacccagttaattttttgtattttttgtagagattagtctccctctgtcacccaggctggtctcgcactcctggcctcgagtgatctgcccaccgttgcctcccgaagcactgggattggcctaccatgcccggcctcacaatacattcttcttaaaataactttcaggctgacaggaaatgccaggtgacaactctgaagtttctgaaggatggcttgaaaatgaggccacctggtgccacctcacagggacagaccagcttcacccccaggtgtaactaccatacagccctcagtgcatgg

SEQ ID NO: 384509 - DNA, 525 bp, Homo sapiens
ggtcagcaccgcagtctgtttcctgtgcttctgcctgggtggccaggggctgcccagaaatgacccagattcacaccccagcctcctgctcccctgtagcatgctgggtttctgtccatggtagcatttgctggaaacatctgttgttcctttccatcctggccttcgttccttcacttgctggccttccctgggaggcaggggcagtgagttcttgggttcggagtcccagggcagtcctggggcaggtgtccagtggatggatgtgtgctgggggtgtgtggaggaccctgcagagcatgcatcgaagtccctctgctacactcactcaccctcaaggggagtctgctgcgtgccggcaccgtgccgctgagaactgggtgcacacggccccacttggtccccattgcatctctgccccagaatggaggtgcagagaggccaggtgtgtgcctggcgctgtagggcaatggttccccaggtggggtgtgggcacctagcaagggcagtgataaaagaaaaact

SEQ ID NO: 384510 - DNA, 230 bp, Homo sapiens
agatccatttgtttgaacaaccctctgtaattaattgtgatgaattatgcctgttttagaaagtattttgtacacatatttttaataaaaattttccccccgaatatttaaccagtatgacattaaaagagtcaggaatttgtctctcactttattttctttttgtggatcaccaattatttttggattattcattaaataaagaatcctctcactgaggttaaatctat

SEQ ID NO: 384511 - DNA, 470 bp, Homo sapiens
agttgcaatcaacgcattgactaaagctgcattatctcagagcttgaccaggaaaggatctgctcccaagctcactctgtaggtgttggcaggcctcgggtcttaactggcattggcaggagacatcagttccttgccttgttggtctctttatgggtctaaaatgtggtagcttgcttccctcagagtgaggagagaggagtgagggagaaagggaaggaagttgaaagagagaaagtaaaacaaaagtcaagatctttgtttaagctaatcttgaaagtgacatcatatcacgttaaccatattctatcaattaaaagtgagtccctgggtagagcccacataggtgagacttcataaggacctcataaggtagggatcattgaggttcgtttcagagcttacgtgccacgccattacatcacaccatacacaaaaataacctgaaatgaatcatagacctaagcata

SEQ ID NO: 384512 - DNA, 206 bp, Homo sapiens
aagctaactgggcaggcagaaagacagcaaaggaaaataaagtgaacaatagtttactcaccaggagttttgcactgcagcccaccagcttgtctgcaactaacttgtaactaggtagtgacattaggccaatcacttaacttcttcatctgtaaaaactgtagcaaaagcttattgctaatcatgagtcagctattcaactaagt

SEQ ID NO: 384513 - DNA, 386 bp, Homo sapiens
agagagagagagagagagatctgtcgataattgatgagattgttcttttcagccaaatttgggagaggtaggatggaggtgctagaccctaataaatgaatgtgagggggtaatttgtaatgtaagaatgataaagaagaaggctgggtgtggtggctcatgcctgtaatcccagaattttgggaggccgaggcgggaggatcacgaggtcaagagatagagaccatcctggccaacatggtgaaaccccgtctctattaaaaatacaaaaattagccagcgtggtgacgcgcacctgtagtcccagctattcgggacgctgaggggggagaattacttgaacctggaggtggagtctgtggtgagctgagattgtgccaatgcac

SEQ ID NO: 384514 - DNA, 1843 bp, Homo sapiens
tgaaacaagctaggccaacttggacattggaggatggattagaacatactagctgctccatcatagactatccttactaagcagaagaccttaatagtgcctaaaagtttagttttgaaattggttttttcctaacttttctttgttaaatttatttttattatcttttttaatcttagaagtaatcagagtttgacagctctttagtaactgttaataaaagaatctttcatcacaggataagcaatagattgtgtgggaaataataacacaagagtaaagatgctgaaggactcttctggaactcaaagtgacagttttgaaggttctggcacagtaggaaaggatcacaacccatataaatggctaatgttgaatttctctgaacactgtcacatatggggcatcaatttggaaaactctcaattgaggccccttccctaagattacaacattgataacctgtcctttttctctctcttctttactatccgtccaagtctactattccaagtttaaatattgttcagaaagttgtcagccttgttagtcagaaaaactccatttagagccatccaaactagcataagaaattccttaagcactcaaagcattatctctgttttaagtaagaaactaaatccagagcttttaacaggtacttagaaataagtattgggtaatcactaagaggacattgactgcaccaaaccaaagctatagaaagaaatgattgactttttaaaatatattcacattaactgtcctaggatacttctcttgaggctttggaaaacttcttccttgaaatttgcatatccactccagttctgtcaccaaagattttaatcttcagatcgcaatttcctctctcccagaaaaaagtactacaacaggctcaagggatatgctttggtggtcaagggattacactatggttttccttctgttcacaatggtatttacaggagaccttgtcatcagaggacgtactgaactatctttatgactttggatttgatcagaggtttaaaaaatagaaaaaaataaacaaccactacttgacactgtaaatgatctttaatagagtcatgacctggagactgatggagagaaagaaacttccatggaagagagtgagctaaatcatttagaaccaaacaaaggtcactggtgaaacatagggcagcatgtacacagtgcagatcagggttctgtatggccagagccaacagcagtgaccggtgggagagtcagacaactggccaatgaattcaagtgttgaaaaagccacagtctggattttgttgtgatttctggagtggttgaaacgcccatgcccatggcaaggaaaatgcttggaggctgatctgttgtgatagtgcctttcttgtcgtagtgagtactagattaataatttattcagttacgcttttctgtaccattgcctccagtcttctgaggaggtttgaagggacagtatccacttaggatgaagggacaggatattgctctggaatgctgtgatttgatgatatttgcactagattctaaactctcctttaaactggagcaactgactgagagaaaaaccaaggacagctcaaagttaaaagaaaccaaaagcagtattttctgacagataccatttctttttctccttctttttttcctggaagaaaacttcacactagttggctaccgagctcaactcttaccagttctttctctttattttttgtttccatatggaaccatctgtgtgaattagtcatcagttaggtatagttaacgtaaagagcccctgccattgaaactttgcacaccttctctgctttattga

SEQ ID NO: 384515 - DNA, 253 bp, Homo sapiens
ctaggatcttagtctctctgtcacactcagtcatccacagggatcagcctgtcggggaaaatgctttggcacagatgctgaaatgaatttaaaagcaaagcagccagggctctatgtcaagaatactttctgtagcagaaagtctgaggagcttaatctcagggcttccagaagaatattcttgatgtgagatggaaaagtacatgagagtcaatggcagaatatgttccgttactacaggaacctataatca

SEQ ID NO: 384516 - DNA, 119 bp, Homo sapiens
ctcaggttagcttttacttctttgtgaatatttactgtgtaagcaggaaagggttcatttccgtccattacccctccttgggaatctgaattctgcatcatctctggtacttggcagcc

SEQ ID NO: 384517 - DNA, 359 bp, Homo sapiens
cagactagaaacacattgtatgagctttattactattttaaataagcacatttctacacatattccatatatgtggaatgcagactggctccgtccgttgcagatgttattaaactactgcataacacactcataatcggtcttagtctcaaaaccatttttagcaaaatacgataagcagctgttaatcatcaactaagtttgagaatttttgtgaattgaagtctatggccagatgtatacggccctgtttgatcgttgagaaacacttgctgtatcaatagatataatgagaatctacaattaagtcaagatgcaaaatactgttaatgataataatatctaatatttataatatt

SEQ ID NO: 384518 - DNA, 2403 bp, Homo sapiens
  misc_feature (2)..(2): n is a, c, g, or t
  misc_feature (4)..(4): n is a, c, g, or t
  misc_feature (17)..(17): n is a, c, g, or t
  misc_feature (285)..(285): n is a, c, g, or t
  misc_feature (1202)..(1202): n is a, c, g, or t
  misc_feature (1779)..(1779): n is a, c, g, or t
  misc_feature (1954)..(1954): n is a, c, g, or t
  misc_feature (2357)..(2357): n is a, c, g, or t
  misc_feature (2389)..(2389): n is a, c, g, or t
  misc_feature (2403)..(2403): n is a, c, g, or t
angntatgttcatattnctgcgtggcctccactctagttatatgctgccgcataatagaataccccaaaacttagtgaatttaaacaacaaccgttgtattataactcatcattttttggatgagaaatttgggcaaggctcagctgaatgattcattaacaacagtcagtcattggaattcatctggtagctgggcctgtcttgagggtttaaggcagctttactcacatgtctggtgccttggtgagcaacagctggacaactggattcacctgagccctttngcctgccccatattctctgggcttctccagatgatctttttctgcaggatggttagacttctcatatggcaattcaggactccaagataccaaaatggaatctcccagtcctcttaaagcctgctggcacagtgtcacttcttccatggaccatctgagattcatggggaaaggaaatacaccccacctttcaaggggaggaatttcaaggagcttgtggccatctttaatctgttactacctcctaactggtcaccctgcctcaaatcttttttcatactctggccatatattcccaaaatctcaatttcattctatcttcccccttctcaaaaacctaagatggcttcctctagcctatttggtttaaattcctctccctgacattcataactcattatataaaagggtcctactataataatcttacctaattttgcattagtctctgtttgttaatcattagtctgtttgtcttacatagtcctcgccttcccctactctgttctgtatcacagggaagctgacccctgcaggatgtttttcctaggctccttgtcaacttcagactgggcctggcaaataggagacattggtgggagattagggggtggcagaagtcaagttatttctccttctctctgcttcatgcagatctctggaaatgattgcatttttatacctcctgtgctccagatccaactggttaagccttctctagttccatcatcctctgagtgaccctggtttctgagctccagaaactctgtattctcccttgtcattccaaccaaagcattgctgacagcttcctgaagttgctcatctctaaattgctatactgtctcctgttcatcatcccaggctttgatcacctttaaagtaaattccctgtattaaattccttctatttaaantaaactcaagtagtttctgttctgattagatcccagctgttctcaacacaaagtatccactccaggctgggcaattttgtacctggcccttcagcccctatgtgcctgttatggtatttctggcctggacctctggcctcattcttcaaagcccagctcaagcttcatcttcctcaaaatgcctttcagcatcactccagtttttactcacctgaccctatcattccttggtgactttcaatgtgtctgttttcccagtttgtaagttcattgaggaagcttgtacttgaatcctattccccacagttcccaccacagtgccaatgcacacaaagcactcaataaatattgcttatttgcttcaatataatatcttttaggtctgactaatttctatgagacatcagggctaaaatcatctgtactcctgaatggagtgaatttagggatgcttttttgggttagtgatactcttaagtttttcccatcctggatgaacatgttataatagacagggagagactatttttgttttgcggtggcaggtagtggctgttaggcacacagtataattcantgtcctatatgaagtagatatcaaatatgaaatgaaaagaaaaagcctacaccataactgatggatttgtgtggaaaagccaatgaaaaaaatatttaaatatgacagtctttttgatacttttataaagtaccattaattctggaattaaagaacaaatatgatctacatatanttaaataagatcataataaaggaaaatgccacagaaaataaatataaattaataaatctaaaatccagtctttcatgtctcacatttcttatgccctagatccatattttattctttttcccctgataacaagtgctggaaacatcagagattcaataaacattttaattgtttgaaaatatctaacagatgatgttcctgccatctagtcgcaaaattgtcttaagggattattttatgcaaaattgttcaatttgggggttttgttttgcaaaataaaatactaataagaaagtttgctacagtatttactgttttcaagccaaaaaaacatgtttatttgggaccagaacatggtccagtttgagttcttaagatctgctataactaactaactcagctnctagtatttcaagatgacatcagaagaagctntgcctttttttgcn

SEQ ID NO: 384519 - DNA, 699 bp, Homo sapiens
aatttcctgaatttagcaaaaagaaaaagagagagaaaaaaaccctacagattcaagaagttaagtgaggccgggtgcggtggttcacacctttgggggccaagatgggtggaccgcttgagcccaggagttcaagaccaacctgggcaacacagtgagacccctgtcgagagagagagaggagaaaaattaaatggaaccttaaacatgataaactcaaagaaatccacactaaaacatctttttttttggagacagattattgctgtgtcgcccaggttggagtgcagtggcacgatctcggctcactccaacctctgcctcctgggttcaagagattcttctgcctcaacctccccaagtagctgggactacaagcacatgctgccatgtccagctcattttttttgtatttcagtagagacagggtttcaccgtattgcccaggctgatcttgaactcctgagctcaggtgatctggcctcctcagcctcccaaagtgctaggattacaggcggcagccaccgctccaggcccaaaacatcttaattgaacttctgaaacctaaagacaatgcagctagacagaaaaatgacacctcacctattggagaagaaaatgaatcaaatgacagagaatttctcttcagaaaccagggagaccagaagaaagtagcacattttttaagtgctgaaagaa

SEQ ID NO: 384520 - DNA, 328 bp, Homo sapiens
gaaggaagtccttcttaagcaaggcttacagactcccagggagaacaaaatctctttatctctctggggttttaggaccctcatcaagtcatagaattgaaatagagaacatcaattgttcaactttttaattttaatagtttttgtagtacataaaaatcatgttatgaattattttgtagttttaattataacttttttagcacttttaccatattcttaaaaattaaaaattatgagttctgagaaagcagtgaaatcacatataggtatttgattaacttttatgtgatcttttacctcaagctaatgtttcttaaaatcaagt

SEQ ID NO: 384521 - DNA, 680 bp, Homo sapiens
ggaaagcccaaaaaccacccatgcctacagaaccaagtctcgtgagaaagaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctttggcttctttgtggctggaggtgttccaggcctggtgagggggtcccatactgttctctgctgagccctctgcacactttgggggatcctggctggcggtggtagttgggccgaagactcagttgtccgtcagctggccatgtccccattttatggacaggcagcctgaggcccagaggcggaaggatttctccttgccacagctgcatcacacttgaactgtccagacctccaccgctggcctgtttgctccccaccctagtcccgcaggctgatatggtgcctccagcagactccatggcttcccggagggtgcagggtccccagttcaccctccagcaggagtggcagcagctggggtacccctagcagtggcatgtggagaagctggggtatgcagaggatccagttctgtgacaccaggaggcacaccaagttttcctctgtccctaacacagaccagaggggtggcccac

SEQ ID NO: 384522 - DNA, 607 bp, Homo sapiens
  misc_feature (580)..(580): n is a, c, g, or t
ggctgtcaacagtcgacggagactctcggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctccattcaatgggtgccaaaaccattgcacccagatcagctgcagacaacagcagggctttcaatgaaaattttaaacaaatgagatcaagctcctgacgcactgctttgaagaattataacaggagctgaaacatgactttaccagtatgatcctgaagacgaagcacaagcaaagcaatggctactgagaagtgaaagtgggccaatcaaaccacaagttgatggtcaagagaaggtctcatgacaacagttttggagattctcaaggcatttttcctattaactttctggaaagcaaaaaaaatgatagcatctgcgtattatgagtgttttgagacactagccaaagctttagcagaaaaatgcttgagagtctccgcgaatgngtacgagccgatagtgggtgaaaaacc

SEQ ID NO: 384523 - DNA, 6923 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384524 - DNA, 3321 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagca

SEQ ID NO: 384525 - DNA, 6878 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaatgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384526 - DNA, 2645 bp, Homo sapiens
  misc_feature (350)..(350): n is a, c, g, or t
  misc_feature (2584)..(2584): n is a, c, g, or t
  misc_feature (2601)..(2601): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacattcgccattggttttaaactcccccccctccaatanaataggaattctaaagnaagaatatcggtagaacatgatcctgtttgcccccgcccccact

SEQ ID NO: 384527 - DNA, 6862 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384528 - DNA, 6764 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaatgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384529 - DNA, 6058 bp, Homo sapiens
tttctctgtcaagaaggggaaagaggcaaagagagaagagggaacagtaggcgatggagaatgacagtccattgttgcagcacagaatatggggccaccaaaggtagtggtggactaccgtcattttaactccatttgcttagcagtgcttctgttacttcattttgggggacatagtcgggtgaggtggctgtggtagagctggaagccagggtgttgggttctattcccagtttggctactactagtagtgtgaccttgggcaagtctacttaaagacatctctaagcctcagtttcctcatctgtaaaactagggtttgcattgaatgatgactttttcagctgtctgctttttgtcttaaatgatattaatgttctaccgtaatactaagtaaaattaaaatggggggttggggaggtggttttgttttaatatgtcagtaaaggctgttaaatggttgaatcctttctaacagtttgcaatgtgaacttctaagctgctttctctgttttaagggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384530 - DNA, 5602 bp, Homo sapiens
tgtctagaggatccctggtgtgcctgtatgctctcatgacaagtagctatgccctccataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384531 - DNA, 5537 bp, Homo sapiens
ctgattctagactatatccacaaagttcacccagggcaggaatgaaaagtgtttggtaaaataaataggctgttctctagcaaagcagtgagctcctgactcccagggtctggtcagagttgctgagtgggttgatctctggtctttccttgacagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384532 - DNA, 5235 bp, Homo sapiens
  misc_feature (6)..(6): n is a, c, g, or t
  misc_feature (11)..(11): n is a, c, g, or t
tctaancggcngccctactactaaattcgcggccgctcgagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctggggttccaagaaaacaagttccttgttaacatagcactgactttgcaacaatagaaaactaacaaatgagcaacaatataaagagtagaggtagttctcattgggtgtaacttcaacccattctgcttgtggttagaatttataattttgctaacgatgtaatttactaaggtttgaaatggtattctaacagtgagtccattgtcttgaggattaatctgatttataagtaatactgatagacatattttcgtacatctgagcagaaataaatgcatgtttctagcatatgtaatataaaaactccagaggataagtttacacttaacaagatgttgttttctatttttgaatttcttattatttccccctttttggtagtggagttgagagggggagcatactatttgtataaagaactgtcaccccagagtgacatttattttccaagatgaccctgaactcatgctgttggtttcatatggtgtttgtgtgctttgcctagattcaaggcctgaggatttgaggaaaatcgggattttttttttcctatttggttttcatgtaaaagttctaaatgtcacttattttgctaaataagaccctttcacaggatagtgtgcgcaatacctgtccgtgtttccaagcagagttcaagttcatgtcttcacaagtagatgagagtcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384533 - DNA, 2086 bp, Homo sapiens
  misc_feature (6)..(6): n is a, c, g, or t
  misc_feature (11)..(11): n is a, c, g, or t
tctaancggcngccctactactaaattcgcggccgctcgatcacttccagtcgggggaagcccgcctgagcagtgttttgagagtgcgtacattggaggactgccccacgtccgtttgcactctgccttgcaaaacttactgtggagacgtgccccagactggtctcagaccagagtttgtggcacaggaaaacctggccccctaaaaagaagttttggaattggaagcctgataatttcgggaggctgaggcaggagaacggcgtgaacccgggaggcggagcttgcagtgagccgagatcgcaccactgcactccagcctgggtgacagagcaagactccgtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384534 - DNA, 2671 bp, Homo sapiens
cctggatgttgtttctccccacagaattgggcccccctctggagattctcatacacagttctgttggggtgtttaccacaaaaaaggggggtttttctctctgtgggcttcttttggccctcaagagatttctcaacagtgcctctcgcaggtgaatattttttgagcgtggaaaaatcttcgcgggagatctctgttttgttttgccccccacttatggcgtgtgtgttcaacactgctgacaaaaagttgtttttgtaagataaggtgccaccccgtcgatatatttggcgttcaaaatattaaagagcccctcctttttccacacccggagaatatatagtgatgtgggcgcgccacaaaaaccctcgtggccgctgggtgttgttttccccacaccacagagggtgtttcacacgggttgtcacaacgttgtctttctcaccccacgtgagagatatgagggagagttccaactctccccaccctctccggggggggagaatcccgctccctctgaggcccacgcgggtttttcgagagagagtggggcgtgacacactctggagaggaactcgtcccccaccacgctcccccctttgtcacacttctcttcccctctgtccaaaaacttcattctctctggagagaacctgtcccccacgcagatcggttctcacgagaccacgaagtttttgtgggcacaccagggaaacctcgtgcccccctctacaaagaaagtgtttggagatatggagagccctcgataatattttcgcggagggccttgatggccacggaagaaacgcggcgttagaaccccggagggccggaggcctttgcacgttgaagcccagtggttcgcacccccttgcacactcccacaccctctgggtgtgaccacagaagccaaatccctttcccaaagtctccaaaaaaaaaaaaaaaaaaaaaaaaaaaggaaacctgacaattctacccacctccccccacccccgactataggcaaagagagttgatcacttccagggtctctgacttctgtgacctggaaatcagcctggcttgggaaattcatgttgttgatctttaattatttaattattctttaataatccttctattttcttgacatctgacccccagcaagagtaaggatcccagaggtcaaaacagtggtgagagccaagctgctcacagacacccacttgatgccacagccatgccatgaggcttcctcccagctgctctgctggcttgctgaagccagctctgagtcacagggttgccttggaccctcggctgtagggggcacctgtctggctccgggccctttgtcctggatacactgacagtaatgtgagcgcagcacttcagagttcaggcccagcaggtcctggcaagtgcattccacccgaacttttaacccaagcggtggggaaggaagccaaaactccaagctgcactttcttggggttctggccatgcacttcttagccttctctctgactttacaggacaaaaggtaccccacgccttcagaatcatgcttacctgcacggcagcatctgactggatggctggctaggtctcatccaccccaaattactgacccttgatttatgttgttactgctcaggttatgctcagatgccctggttgcctgaagatggtttaagtgcaggcccttcagacaagtcacgtcaggcaagagagggctggcctctaacccacaagagggcagatttgtggccaagaggcttcctggcatccacccccaggcccaagggatcagtgtggtgccagagaggatctttaagctgggactgtactgaggcttgatgggaagtatgggcagcatgtacttgacacgttatcacccagtccccttgtaaaatctggaatggagcgtttaagctgagcgttagcatcaggtcagcaggcaaagcaaacctcccacaaactgggtgccgtaaggtgggaggtgacacatggagagcttcgtcctggccgagcaggcacccagccccatgtcccccgccagcattctggatgtcagaggagggtgcgtgtgatggcgtcacattcatctgaagcacactgattgattttccacaaggtggcaagtttgatcaaattgaccgcttttcatgagacaaccagatgctgtaaaaaaaaaaacagcactgggatgtgttgaggagggggcagtttgctgtgctctgttctgtctgctgctctctctgggggccgcacaatgtccgcacacatcacggaggggagaaaggcatcagtaccaaacggaacaacctcttttttctacattgtccatacccggacatgtgaggctctattatcaacaggtggtgagaaaaattctgtttttattcgctttctggtaacttctgtaggccctggctcaaggacttagcatttcgtctcatgtacatctttttcttaagtgttctttgccatttctggaattgtccttggtttttccttagctcataggtcatagatgcagaaatatagtatttaaggcatccgcatccagcatcagatggctttgcatccagaaaaacattgataactcagtttgaagcaccaagcatgtgtaatatggctctatacaatataataaatgcataatgttaagctttaaaaaaaaaaa

SEQ ID NO: 384535 - DNA, 162 bp, Homo sapiens
atgatttatgccagttgagtctacccactcctacaaatctgtctgtctctctttttcttttgataagaatgaagccaagaaaaattaaagaagatgatgctccaagaacaatagcttgccctcataaagtaagtaatgctagagggagagtgttcattaaac

SEQ ID NO: 384536 - DNA, 193 bp, Homo sapiens
ctcgtcaaagcagactttattggggcgacagggccgccccgcacgcgccagccgctccccgcgcggcccccgggcaacaagaagtgggagcagaagcaggtgcagatcaagaccctggagggcgagttctcggtcaccatgtggtcctcaggtgagcgccggccgcgcgccccggccccgggatgtttttgtt

SEQ ID NO: 384537 - DNA, 4669 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaattgagtgccagtagcttaatttcatgtttctaaatggacactgggtgcaaatcggcaaggtgattagattattagaaaattctgctcaatgagtacctctcacattgtaacctcttaaatgtacgattataatgttggatcttaggtcaaataacagacttgagaatactttataaactgccatgatacagcaaaatctcatttattcaaagtgcaaacatactgtgtgtctttctgttttgtgtatgcttgactgcaagataaatgacaaactagctaatatccgagatttatttacaaatggccagggaccccatcaggtgaaacacatagcccattgtcttagagcttctccatcggtcctgtacaggaggattggtgacctactaacagtgaccctgtggctctgtggaattttgaagtgccttttgtgaatcatgaatgaaacatttaacttgagaccctttaaaaaattcatccagaatctgttaccccttgggtagtttgatggaactgagttaagcagaagaccccagctgttttctgggtaagccaggctttgctgtatctggcagtcaggagagaggtcagcccatggtggaggtcttcagtgccgagggctcggatgagaacgtgtagttctttgacttggacctgggcagcgtcttctatggatgcctgccttgtgagcacccacaccttccctccccactgtcgggttgagtagccccagcgtggctgtgttaggagtcctttgcccaacattgtgctgcactggagcctggccctggcactgtcctcaggaccctgcccaagggcccaccgcagagcacacctatgctatggggagccctgctggcagccccgagagccatgccatggcctgcaggagccaggctcctgtgtggatgaagtccctcttcctctgtgccttgatcccttgggggtgcctttggtcatctcttctgtcctttcctgtctctgaaatagtcatcactccccttgactctctctgttcacgtcttctcagtctgcagagttaacttctgtaaggagtttaatctttggcttctttgtggctggaggtgttccaggcctggtgagggggtcccatactgttctctgctgagccctctgcacactttgggggatcctggctggcggtggtagttgggccgaagactcagttgtccgtcagctggccatgtccccattttatggacaggcagcctgaggcccagaggcggaaggatttctccttgccacagctgcatcacacttgaactgtccagacctccaccgctggcctgtttgctccccaccctagtcccgcaggctgatatggtgcctccagcagactccatggcttcccggagggtgcagggtccccagttcaccctccagcaggagtggcagcagctggggtacccctagcagtggcatgtggagaagctggggtatgcagaggatccagttctgtgacaccaggaggcacaccaagttttcctctgtccctaacacagaccagaggggtggcccac

SEQ ID NO: 384538 - DNA, 2714 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttccttta

SEQ ID NO: 384539 - DNA, 3464 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaagcaagaatatggcagaacaagatctgtaagcacagtcttattttcttttgttgtccagaatacttataattcttgagcctcccagaaattggaagctaaataaagcaactcaagtttcctttattttgcactcaattacagtgattattgatgaaagcgatgcatggatattttaatacttcctacatgtcctgacttctgaaagagagtaggtaacaggcatcccgagttcaggaactacctcagaacaccccaggccaggttggtcataggctgtgattttagcccccggcaagtgtgagtgaagcatctgtaccaccgcgcaggctgagcgcctgcgcagggtaaggtgccacctggcagtggggcacacagagggaagaccaggcctgtccatcagccggctgccttcagaggcagctccagcaggaccttggcttgtctgacaggaaatgcttgtggtcgttggttatttggtttgagagcccttgttcctccatctagtggagtccttattaaatgctagcaatgtggcaaaaaacaaaacacaaaaaaaaagggggggcccgcttaaaaaattaccccctggggggcccccagagtttaacgggcgtgttcatcccccaggcttttcctgtggtcacccaaagggggggtcgccccttataagagcaaggtccagtaaattaataaacagcataagggacttggcggcccgagtccttttttaacacaagcgtcttcttagcatcgtgggaaaacacccctgcggttaaccttcggagcaactccttcgggagacgaaggaacccctttaacttcctcgtgggtgttacacaataattttgggccaaacactatcaccttacaggg

SEQ ID NO: 384540 - DNA, 2160 bp, Homo sapiens
  misc_feature (350)..(350): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctttttggctttaccaaattttttttttaaatttttggtttttttcccaaagttgttgcattatttgttaccccttttt

SEQ ID NO: 384541 - DNA, 1576 bp, Homo sapiens
  misc_feature (350)..(350): n is a, c, g, or t
  misc_feature (1498)..(1498): n is a, c, g, or t
  misc_feature (1501)..(1501): n is a, c, g, or t
  misc_feature (1505)..(1505): n is a, c, g, or t
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgcnccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaactnaanggancactggtcatatgggagaccttcagggccgcgagcggtgaaggctcctggctcattggcctggcatctcgg

SEQ ID NO: 384542 - DNA, 314 bp, Homo sapiens
ggaaaactagagaaaagagaggagaattaattgctgatgatgcaagggccttccaagtcatgttaagaagttctggctacagcatggaagtcttaagactggagctatggagaccagttaagagacagctgcgtccatgggatgcttgatagaaacctacactagagcatggtggtagtcacactcaaaagatatttaggagactcaattgacctcatctggtgattgatcagatgggagtggagatggtgaggacagacatgaatcaagaataactagatttctgccatgggcattaggtggaaggtttaata

SEQ ID NO: 384543 - DNA, 876 bp, Homo sapiens
  misc_feature (100)..(100): n is a, c, g, or t
  misc_feature (249)..(249): n is a, c, g, or t
  misc_feature (267)..(267): n is a, c, g, or t
  misc_feature (572)..(572): n is a, c, g, or t
  misc_feature (757)..(757): n is a, c, g, or t
  misc_feature (815)..(815): n is a, c, g, or t
ctgcctctgggctgtgatctgcctcaggcccacagcgtgggtaacaggagggccttcatactcctgacacaaatgaggagaatctctcctttttcttacntgaaggacagacatgactttgattttccatcatcaggtgtttcatggcaaccacttccagaaggttcaagctatcttccttttccatgagatgatgcagcagaccttcaacctcttcagcacaaaggactcatctgatacttgggatgngacccttttagacaaatnctacactgaactttaccagcagctgaatgacctggaagcctgtgtgatgtagaaggttggagtggaagagactcccctgaggaatgtggactccatcctggctgtgagaaaatactttcaaagaatcactctttatctgacaaagaagaagtatagcccttgttcctgggaggctgtcagagcagaaatcatgagatccttctctttatgaacgaacttgcaggaaagattaaggaggaaggaatgaaaactggttcaacatggaaatgagaaacatttccatgattaatacatcatctcacacnttcatgaattctgccatttctcatttttgctatatccatgacatgagttgaatcaaaattttaaaatgttttcaggaatgttaagcagcatcatgttcagctgtacaggcactagttccttacggatgatcatgctgatggatctgtttatctatttgtctaaataattatttaactatttatantatttaaaatcttcttttcatgtatcatgtatttttactttgtggttaatataacaanacatgttctttatatttagtcaatatattactttgcttttttcattaaatttttactatgg

SEQ ID NO: 384544 - DNA, 234 bp, Homo sapiens
gttgtgggagggacccggtgggaggtaactgaatcataggagcagtttcccccatgcagctgtcgtgatagtgagtttctcatgagatctgctggttttataagcttctagtgtttcccctgctggcactcattctctctcctgccaccctgtgaagaggtgccttctgccatgattgtaagtttcctgaggcttccccagccatgcaaaactgtgagtcaattaaacctcttt

SEQ ID NO: 384545 - DNA, 259 bp, Homo sapiens
cactccctagtgagatgaacccggtacctcctaaaataaaagttgaaagtataaaagaaggaaaaagagaaaataaaaaacaatgatatgttaatttttaccatcagaattaatctgcagagataatctgtagtgaatttgtgtatgtgtacacattgtgactcttgagaaaaatcattctacatatacacaaagagattgtccagaattgttaatcaaatcaaagagtgcgaaacaatgtaaatgtctgtaaataggg

SEQ ID NO: 384546 - DNA, 268 bp, Homo sapiens
tgcagtggcgcgatctgtaaaatcactgtgagcactgacttagcacatactggaccgttgctcctaggagaaatacagggttgcgttcctgtgagctttggtcgtgatattttcatcagctgatcaatatgtaatcttgttttatgtgtatttctgtttaaagattcatatatatatgtgtatatatatatatggttgagttgttaccgttgaactcacagcccacaggactagaacacatgcctaaataaagtttatctaacatact

SEQ ID NO: 384547 - DNA, 247 bp, Homo sapiens
tgcagtggcgcgatctgtaaaatcactgtgagcactgacttagcacatactggaccgttgctcctaggagaaatacagggttgcgttcctgtgagctttggtcgtgatattttcatcagctgatcaatatgtaatcttgttttatgtgtatttctgtttaaagattcatatatatatgtgtatatatatatatggttgagttgttaccgttgaactcaccacctgagcatacagggtcctctgagga

SEQ ID NO: 384548 - DNA, 2627 bp, Homo sapiens
  misc_feature (2571)..(2571): n is a, c, g, or t
  misc_feature (2573)..(2574): n is a, c, g, or t
  misc_feature (2627)..(2627): n is a, c, g, or t
cgaatattaaaatgattgtctaatgtcacacagtagttttaaaagaattagaaaaagaattcaggtcttttgaactcctacccagtacaattgtcaaaatgaatgctaaaatttgtggattgaaaaaatatggtgtctgtatataagtgtaatagtgtgtcagcagcagcagcagcagtagaaatagtaatggtagatagcatctagcaaaagcagatcttcggagaataatataaaagtagcatactatgcaatctgaaaagcattgcccttgagtggcagcccttttggagggatgcgataacttgtctcctgagattaacatagatactaacttttttaacgttagcttaattggtattattttgggaagtactaatttgttctgcacactaaactgagagagcaaatggctccttaagggcctccatgtctgccaatagactaattctaagcaattggaaaagcaaattagattttctcagaaaatgtatggaataaaattcttttagtactagataccataaggaaaaaaaggacaaaatctgcttgacagagtaaatatatcagagtcaatgatgaagagattctggaccaaatacttactgtggtaaattgggaaaaagagtggtagtgataatgattcaaaattggcaatatataacgtgattattccagagtcatatgattcgaccaaattttgatcctgagcaatttgtttcagttgctcagtgaatgtgtttatgcacagaagcatttattagtagtagtttctacttttcatagtttgctagtagaaaccatgccatataaatgaaagtgatttaccatgaaaaagttataattagctattgccttcctaaccaatgttttggcatcaaataaatcatatatatatatacccaacaatgtcataaaaccaaagttattagaattatataagtctgaataattttccccactaaaattatgccagcaaatattgtaaaatgaacacaggttcaatatgcatatgttcttcagtggtttctaatttaaagtttggataatagctcataaatatacagtttgactacactgaacaagtaaccccaaactgttatgtttcttataaataacattaaacatttaattaacaattctatttgccatgatagaacttagaaaagctttgttgaaaagttattaattagaaatatatcttttcaaataaaattggtattttctttgtgctcaatctacatctaaatttcaaagtacatattcacagtatctccagtcacttcaacgctcccatcattattcttgtcaaagataatatttctcttccaaaatgtttttaaatattagaactaagccaatttatatccctttctttttatcctttcttacctcctcattttatgcaaagctgctcaatctcattctaagagaaggttccagtgaacaataaatggtacaaagccttggttgaatgagctatcagaaaactttacacttaagctatgatagcaaagatcaagtcatcatcaaaggattttagaacttaaaaataaatcttagtgaattacctctataggaataatatattatcattgggctgcaaaactgctttaaaatttatataagagaaaaagataaataaaacattcaaatatttggggtatggatgttaagcattaagtgtagttcttgcacagctattaaaaacaaatcactgtgaaaattaaatggtgtgggacttctgttccagacaagtatatctggtatagacctgcttcttcttgctcctccctgctaagcacagctgtaagctggaaataatgcaaccaacaaccaaagaagaactctggaaggtgacaagagaacagaccggtttgggatcccagggttggaggaaaaacagagtagcggggaatgtcttacatttaccccaaccaagaggagaaaatgaagtcagaccaggcatttgctgattccaacctagcaacagaaggcagcccacatattctaatttctcttctgagatcaattaagagtacctctgagaacactggacaagtctgacaccaataaaaggaggatcaatcaacaagtaatcccatcaatttaaatcagccatgaagcactcccctttcccacttgattgagattctcttcccctccaagagatactggaaacaatgattggaagcagcaggagggactcagtcacaacaattggcttggtcttggatgcctctttggacctgagacacccattttctacccaccaacactgggtaggcaagagaagccagcagaaccttctagagggaccaagccatagcaagaattcctgcctgaggatctcttttacgcaacttcctttgaggaagaattatgtcagatgggcaaaagaggcaagaggactcaacaatggtaattacccaggcctagaaaactcctctctgtccagggtcactagcgctggtggcagaatcagcaatagggacccagtaacaacaagctgccagacctaggacatctcttttacactcctgacctgagaatcatcttccctactcaganannctgtccttctgtagctggcagacccaggcctacttgaggcacttcatcttggn

SEQ ID NO: 384549 - DNA, 369 bp, Homo sapiens
aaattgagtagcttataaacaatggaaatttatggcttatagttctggaggctgtaatgtccagggtcaggctgctgacagatttggtgcctggcgagggcccactttctggttcatagatggcttgtcttttcactgtatcctcacctgggggagggcactaatgccattcatgaaggctccacattcatgacctaattgtctcccaacatctccaactcttaatacagctctttctccgtatccacaggggattggttccaggagccctgtagattccaaagtctgtgaatgctcaagtcccttatgtaaaatggcatacttccaacctgagcatcatagtgagaccccacctcctcaaaaaaaata

SEQ ID NO: 384550 - DNA, 1206 bp, Homo sapiens
ctttatttacaaaaacaagagcgtgaggaggaaagatggcggacgaggagaaactgccgcctggctgggaaaagcgcatgagccgcccctcaggccgagggtactacttcaaccacatcactaaccccagccagtgggagcggcccagcgggaacagcagcagtggcggcaaaatctggcagggggagcccgccagggtccgccgctcgcacctgctagtgaagccagtcaaggcggccctcgacctggcggcaggaaatcacccggaccaaggaggaggccctggagctgatcagcggctacatccagaagatcaaggcaggagagaaggactttgagtctccggcctcacaattcagcgactgcagctcggccaaggccaggggagacctgggtgccttcagcaaaggtcagatgcagaagccatttgaagacccctggtttgcgcggcggacgggggagatgagcgggacagtgttcacggattccggcatccacgtcattgtccgcacggagtgaggattgggggcccaggcctggcctcggggttcccccgctgcctgctggccagtggccgaaccccccactccctgccactgtcacacagtatttattgttaccaaaatggctgggagggggcccttccagactgggggcccttccagactgggggccctggggttccccactccctgtcagtccccagttggggctgcgacctccagactctccattaaggagttgacttcagcatgggagggaggctcgcagacccagggcaatgtggtgggaggagtgttccaaagagaagatctggtcagcagagccgccccatgtcccaccaggtcctggaggcagatgcgagggcccagagttgtttgtagttaggccacgcttctctgttcagtagcaaaagcaaacactcgtgggcccagctgtgggccctctgagcaactttgcagcaccctttcacccccaattaaatccggaaccactaaaaaaaaaaaaaccaccaaggatgccagatagacttgagcatgctctgttttggaaaataaacattggcaaattttagtaagtctaaattgaataatcagtgtgtttaggagtctggaaacactattatacaagggatttaagagatcattaatatttatcctatacaaagataagtcctattactaataaaatattccttaatacact

SEQ ID NO: 384551 - DNA, 441 bp, Homo sapiens
ctcacaacaaccctgtaaagtagggttttaaaattaaggaaattgaggctctgaaaggttaagtgacttgcctaaggtcacatacccaagaaatagtggagcaggaattcagcttaaaactggctacactatgctgcctcctattaataaacttgcattaaacatattcggccgggtgcgatggctcacgcttgtaatcccagcactttgggaggccgaggtgggtggatcacctcagctcaggagattgagaccagcctggacaacatggcaagaccccgtctctggaaaaaagaaaaacaaaaaaactagccaggcatggagacgagcacctgtagtcccagctactcggtgggaggcttgcttgagcctgggaggcgcaggtcgcagtgagccgaaatgtcgccagtgcacgccagtctgagaatgagaccgtgtctc

SEQ ID NO: 384552 - DNA, 390 bp, Homo sapiens
cttcatggagagacttggcaacagtctctttccagaggtcaggcatcagatagctgtaggtcttggagatggcatcaaaggtagccttggtaaagttgcctagggtggcagtgcagccctgatcaaggtgtagcagtcattgacactggccatcatcagtagcttcttaggcaaaggggcagagacattgccagtgcatctgagggcagagatgaggcacaccagcacagggccaaagtggtcagtcactccacaaggaatgatgtggagcataccaatcttattccccaatagcttctgcatggggaaaatggagagcttggccagggtgatggaccctcagatggcagtggctacctccctgaaacatttaacacccagatgatgtgg

SEQ ID NO: 384553 - DNA, 497 bp, Homo sapiens
tgaagatcaaaggggatctgttgtaatgcctggcatgcagtaggtacttaatagtagctcttgttgcaaaaccaagcagtgaacatgtatctgactttctataacccccttccttggggcctccactcatgaggcatgggaaggtgttttttttctttgtttgtttgtttgtttgaatgcagttgactttttttttgttgtattgttgcaaaagtaatccatgtgattgatgtttattatgaagaaaacatttaatacagatgaaccaggagaagaaaatgaagttcatccttaatcccagcacccagagataaaccactgttaacattttggaatgtgtcctgtcaggcattcgtttatacacacatatatcttatttgcaaattggggttactggtgcaatttttctaacctgctttttctcccccatttaacagcgtagtgtatccatgtttccatttcaataaatattcttctacaacatcaatttcagtgcc

SEQ ID NO: 384554 - DNA, 325 bp, Homo sapiens
acttagaaatttatatgaacttttgtataaacttacctttgtggatgctgttacagaatttattacaatttcttatggagtttaacaactccgactcatgaaattgctataactctcatttcccaaaccaaaagatcaaattgaaatgatatttatgagcttattttatattgctggagctttctaggtctgctccgtcctccagcagaactactcctgaattcatctgcaaagaatagtaagccttatctgttcttttctctctctttttaaagctttcctgctccttacaatatttgcagtttcaacttgtgtcacataggaa

SEQ ID NO: 384555 - DNA, 356 bp, Homo sapiens
agatgtttggatgtgatttaataagaatgtggttgcaataagcactcagaatatgtttgcaatcaatttgctgtatacacaatatgctaccagagcaatcttttgtgtacgtagttgacctttatctctggcaatcttgtcctataaagaagagtgaaatcctccattgcaaatcattagcactcaggaaatagctttaatttgcatgctgacaaagatattaacttggtggttggcgggggggagaataatacaacacatccttttgtctgaaaggcagttcaaaatctgtgttgtgactacagttgactgaagttcaattactgtaataaatgtattccaaatttcatctcaat

SEQ ID NO: 384556 - DNA, 442 bp, Homo sapiens
gaggcctccccagccatgtggagctgtgagtccattaaacctctttcctttataaattacccagtctcaggtatgtctttattagcagtgcgagaacagattaatacacctgtatacctaattgctgttgtgaaacacatttctgcacaaattttaggttataggttttctgtgttgatgaggtgaaaaaaaaaagcctaaactaaatttaagtgaagttatataaacattacatctgccattattctacttaatgccacctaagtgtatccatgaaactcagtatataaacctggtatagaccaagtgtagggtcagaggctggctgagggagcaatgggatgacgtgaagctgaaagcaagacactgctgcaaaatatcctacactctagcctgctgactcctcccattatttgagatactcctttagaaagaatggaag

SEQ ID NO: 384557 - DNA, 436 bp, Homo sapiens
  misc_feature (29)..(32): n is a, c, g, or t
  misc_feature (35)..(35): n is a, c, g, or t
ggcgaagaaggggcgcaagctcattgcgnnnnagncgggacccctgttggagagactatggcgctcaacaagaatcactcggagggcggcggagtgatcgccaatggaatgtacccctgccctcctggctacccctattccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgaggccagccgccgccacctccctactacccaccggaagataagaagacccagtagcgcctcctgcctccctgcctcccacc

SEQ ID NO: 384558 - DNA, 810 bp, Homo sapiens
  misc_feature (29)..(32): n is a, c, g, or t
  misc_feature (35)..(35): n is a, c, g, or t
ggcgaagaaggggcgcaagctcattgcgnnnnagncgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggtactcttacatgcccagcgggccttatgtctatcccccgccagtcgccaatggaatgtacccctgccctcctggctacccctattccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccaaccgcatcacccgttc

SEQ ID NO: 384559 - DNA, 349 bp, Homo sapiens
gtcaagctgatacgagggtgaaggcggaaggggaggtggctgggaaggctctgcttcctacaagttgactttcacggcagggggcgccattgagttcggacagcggatgctccaggtggcatctcaagagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgagccaaccgcatcacccgttc

SEQ ID NO: 384560 - DNA, 870 bp, Homo sapiens
  misc_feature (29)..(32): n is a, c, g, or t
  misc_feature (35)..(35): n is a, c, g, or t
ggcgaagaaggggcgcaagctcattgcgnnnnagncgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaagcctccagaggtgaagtccccagtggagcctatggtactcttacatgcccagcgggccttatgtctatcccccgccagtcgccaatggaatgtacccctgccctcctggctacccctattccaccgcccccacctgagttctatccaggaccccccatgatggacggggccatgggatacgtgcagcccccaccaccgccctaccctgggcccatggaacctccggtcagcggccccgatgtcccctccactcctgcagccgaagccaaggccgcagaagcagccgccagcgcctattacaacccaggcaatcctcacaacgtctacatgcccacgaggccagccgccgccacctccctactacccaccggaagataagaagacccagtagcgcctcctgcctccctgcctcccacc

SEQ ID NO: 384561 - DNA, 804 bp, Homo sapiens
  misc_feature (29)..(32): n is a, c, g, or t
  misc_feature (35)..(35): n is a, c, g, or t
ggcgaagaaggggcgcaagctcattgcgnnnnagncgggacccctgttggagagactatggcgctcaacaagaatcactcggagggcggcggagtgatcgtcaataacaccgagagcatcctaatgtcctatgatcacgtggaactcacattcaatgacatgaagaacgtgccagaagccttcaaagggaccaagaaaggcactgtctaccttaccccttaccgggtcatctttctgtccaagggcaaggatgccatgcagtccttcatgatgccattttatctcatgaaagactgtgagatcaagcagcccgtatttggtgcaaactacatcaagggaacagtgaaggcggaagcgggaggtggctgggaaggctctgcttcctacaagttgactttcacggcagggggcgccattgagttcggacagcggatgctccaggtggcatctcaaggtatccaggctccgaagattaggggctaaagacacactaaacatgtaggggtttggtatgagtttgcttccttttcgttttgctttttcaagaactcaagaggtaagtgtttgggcaccaggctgaccaggcctaggagttgggaaggaaagctgtcattggcatcagctctgtcctgtacctcagagactgcgtttccctgcctggggcaggtggatgacgttttgacaaagctgtttggactcaaggacactttactatggcctcataaaacaaacactaaaccaaccattcgactgcggttccgcagccattgaaaatgaccgagggatgggccagcagacatcctc

SEQ ID NO: 384562 - DNA, 1008 bp, Homo sapiens
accctggacctggccactcttctctggcggaagcaggttccgtgcgggccctacagcagcatccaagcccctgtcctctcggcacctgagttcttgtttggcatccaggaagaattaggtcacccacacggattgaaaggatatggacaacgaccagtctttccgttgtttaacgaaagcggcagttggattcctcccagaagtctacccaaggatccccagcgaaagggagccatagtccgaggctctggctgcctgcctgtttggagctttgatggcctcgaggcccccagatgagacaggattgttcccttcatcttaacccccttcgtgggcgggaactggagcagctcatttcactcagctcgcctcctgccactcctggcggcagagcgtgcgagtgcgggaaccggagcgaccgaatgctggaaccggccggtcactcctctctggcgggaataggctctgtgcgggcctcacagcagcgtccaagccctggcctctcggcaccggggtacctgtccggcgtccaggaagaattaggtcatatgaacggattgaagagtagtgtatgcggaagatttgattgagtggtggctcctggtgggatgggaactggaaagcagacggtgaaagagggtcatctttccctgaagccgcaccatctgaagttagctgcgtctatctgtagtcttcaacactcttgctgcttctctgctcaccgctcagccgcttgtgttgctctgccagctgaagtcttttttatggccacaggataggggcgtggcaggccaaaaaaacaacatttgggcagaaaaacagggtcagctgttttcaaggccgtgattccaggcttaagggtggggtttagctgggaacccagccattctgtatcagtgatagttgcacaactataaatatactaacaaccattgaattgtgtactttaagtagattaaccgtatgatatatgaattacatctcagtaaagttgttttttaaaaaata

SEQ ID NO: 384563 - DNA, 266 bp, Homo sapiens
  misc_feature (260)..(260): n is a, c, g, or t
atttctttgacgtgatacagaacaaggacatcctccatgatcctcccttctgctgcccaagacttgagagtcatttccttgtcgccaatcacacacaggcacacaccctctggcccctgcctccctctctcagccttccccaccctgtgttcgtgtgttctcattgttcaactcccacttatgagtgagaacatgtggtgtttggttttctgttcctatgttagtttgctgagaatgatagtttccagcttcatccatgntcctgc

SEQ ID NO: 384564 - DNA, 208 bp, Homo sapiens
atttctttgacgtgatacagaacaaggacatcctccatgatcctcccttctgctgcccaagacttgagagtcatttccttgtcgccaatcacacacaggcacacaccctctggcccctgcctccctctctcagccttccccaccccctctctacccttccaactctgtcttgagctcttgaaagctcaaaataaagccaccctttctc

SEQ ID NO: 384565 - DNA, 3381 bp, Homo sapiens
gcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttagttttttttttttttttttggagacagggtctcgctctgttgcccaggctggagtgcagtggcgtgatcttggctcactgcaacttccgcctcctgtgttcaagcgattctcctgtctcagcctcctgagtagatgggactacaggcacaggccattatgcctggctaatttttgtatttttagtagagacagggtttcaccatgttggccgggatggtctcgatctcctgaccttgtcatccacctgtcttggcctcccaaagtgctgggattactggcatgagccactgtgcccagcccggatatttttttttaattatttatttatttatttatttattgagacggagtcttgctctgtagcccaggccagagtgcagtggcgcgatctcagctcactgcaagctctgcctcccgggttcatgccattctgcctcagcctcctgagtagctgggactacaggcgcccgccaccacgcccggctaattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaaaaaaaaac

SEQ ID NO: 384566 - DNA, 1473 bp, Homo sapiens
gcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaaaaaaaaac

SEQ ID NO: 384567 - DNA, 2893 bp, Homo sapiens
gcctggcgttccaggggcggccggatgtggcctgcctttgcggagggtgcgctccggccacgaaaagcggactgtggatctgccacctgcaagcagctcggccatgtggctccggagccatcgtcagctctgcctggccttcctgctagtctgtgtcctctctgtaatcttcttcctccatatccatcaagacagctttccacatggcctaggcctgtcgatcctgtgtccagaccgccgcctggtgacacccccagtggccatcttctgcctgccgggtactgcgatgggccccaacgcctcctcttcctgtccccagcaccctgcttccctctccggcacctggactgtctaccccaatggccggtttggtaatcagatgggacagtatgccacgctgctggctctggcccagctcaacggccgccgggcctttatcctgcctgccatgcatgccgccctggccccggtattccgcatcaccctgcccgtgctggccccagaagtggacagccgcacgccgtggcgggagctgcagcttcacgactggatgtcggaggagtacgcggacttgagagatcctttcctgaagctctctggcttcccctgctcttggactttcttccaccatctccgggaacagatccgcagagagttcaccctgcacgaccaccttcgggaagaggcgcagagtgtgctgggtcagctccgcctgggccgcacaggggaccgcccgcgcacctttgtcggcgtccacgtgcgccgtggggactatctgcaggttatgcctcagcgctggaagggtgtggtgggcgacagcgcctacctccggcaggccatggactggttccgggcacggcacgaagcccccgttttcgtggtcaccagcaacggcatggagtggtgtaaagaaaacatcgacacctcccagggcgatgtgacgtttgctggcgatggacaggaggctacaccgtggaaagactttgccctgctcacacagtgcaaccacaccattatgaccattggcaccttcggcttctgggctgcctacctggctggcggagacactgtctacctggccaacttcaccctgccagactctgagttcctgaagatctttaagccggaggcggccttcctgcccgagtgggtgggcattaatgcagacttgtctccactctggacattggctaagccttgagagccagggagactttctgaagtagcctgatctttctagagccagcagtacgtggcttcagaggcctggcatcttctggagaagcttgtggtgttcctgaagcaaatgggtgcccgtatccagagtgattctagttgggagagttggagagaagggggacgtttctggaactgtctgaatattctagaactagcaaaacatcttttcctgatggctggcaggcagttctagaagccacagtgcccacctgctcttcccagcccatatctacagtacttccagatggctgcccccaggaatggggaactctccctctggtctactctagaagaggggttacttctcccctgggtcctccaaagactgaaggagcatatgattgctccagagcaagcattcaccaagtccccttctgtgtttctggagtgattctagagggagacttgttctagagaggaccaggtttgatgcctgtgaagaaccctgcagggcccttatggacaggatggggttctggaaatccagataactaaggtgaagaatctttttattttttttgtatttttagtagagacggggtttcatcgtgttaaccaggatggtctcgatctcctgacctcgtgatctgcccacctcggcctcccacagtgctgggattaccggcgtgagccaccatgcctggcccggataattttttttaatttttgtagagacgaggtcttgtgatattgcccaggctgttcttcaactcctgggctcaagcagtcctcccaccttggcctcccagaatgctgggtttatagatgtgagccagcacaccgggccaagtgaagaatctaatgaatgtgcaacctaattgtagcatctaatgaatgttccaccattgctggaaaaattgagatggaaaacaaaccatctctagttggccagcgtcttgctctgttcacagtctctggaaaagctggggtagttggtgagcagagcgggactctgtccaacaagccccacagcccctcaaagacttttttttgtttgttttgagcagacaggctaaaatgtgaacgtggggtgagggatcactgccaaaatggtacagcttctggagcagaactttccagggatccagggacacttttttttaaagctcataaactgccaagagctccatatattgggtgtgagttcaggttgcctctcacaatgaaggaagttggtctttgtctgcaggtgggctgctgagggtctgggatctgttttctggaagtgtgcaggtataaacacaccctctgtgcttgtgacaaactggcaggtaccgtgctcattgctaaccactgtctgtccctgaactcccagaaccactacatctggctttgggcaggtctgagataaaacgatctaaaggtaggcagaccctggacccagcctcagatccaggcaggagcacgaggtctggccaaggtggacggggttgtcgagatctcaggagccccttgctgttttttggagggtgaaagaagaaaccttaaacatagtcagctctgatcacatcccctgtctactcatccagaccccatgcctgtaggcttatcagggagttacagttacaattgttacagtactgttcccaactcagctgccacgggtgagagagcaggaggtatgaattaaaagtctacagcactaaaaaaaaac

SEQ ID NO: 384568 - DNA, 579 bp, Homo sapiens
aacgaccccctttcaagcactctgtgggttttgtggcatctctacttgccagagtaaaatggaagtcatgtggtctttttgcacatttacgttaaggaaagagaaccctaaggttgacctgcaaactgtaatgttcctaggtccccttttcctctattttcttttccacctactttaaatctgctgttacttttctattaagataaaaaaccactgtttggatctaacaggttttatttttttccaaacttgtgaatttgtatttatctcatggctaaagtactgaactaaaagctatagaatctttgtgtgtctgtatgtgtgtatgtgtatgtgtgtgtatatatatatttaaaggcctttataatagacttctacaattttatgttcaattggcaattatatctgttttaatttccctctagctcaccagactttctcttcgtaccttataatgtaaatttttctatctgattttcacctgagttgtttcctctaatatgcagatttagggctatttagctgacaactgctgcagtaaggaagcaggttatcaagagtctgcaagtctaagagagg

SEQ ID NO: 384569 - DNA, 447 bp, Homo sapiens
aggctcttccgtgccagctgctttctgtgcattctctcccatccccgcaagatcttgcaaggtaggaggttttattccctgcgtgcctcctttatttttttcaaatgaggcctctaaggctcaaaaacactaagtaacttgcccagtcaaggtacacagcttataagtagtcaggctgaaattttaaaccaagtctgcagtattttgttaagatactttaagaaaagaggtaaaaggacagaactcaacattgttgtttttaaataaatgtttcattatagcagaagcctcttaggaatttccattggtgatgaatttttaaaaggggttactgaaaatgtgttttaccaaaaaggcaagctcacttttttttctcctgtgctctccggcagtcttcagtaggcattcaaagtaaggatttttaaatatgtatatatttcagtgacc

SEQ ID NO: 384570 - DNA, 154 bp, Homo sapiens
cacccccctcagcctcccaaagtgctgagattacaggcgtgagccactgcccctggcccagatttgaaattttttaaaaataaaacatgattcttggttattgtaggtatttaataaatgttaaataaatatatacatagaacaaagtagtgcc

SEQ ID NO: 384571 - DNA, 331 bp, Homo sapiens
  misc_feature (189)..(189): n is a, c, g, or t
  misc_feature (191)..(191): n is a, c, g, or t
  misc_feature (268)..(268): n is a, c, g, or t
  misc_feature (296)..(296): n is a, c, g, or t
ttaagtgactggaattttaagttataactcctattataaaaagttaacttgactataacttgtaaagtcaactcctcaatcctcttaatcatttggtagacttctgactttatattcaatgagataatcatattatttttattagaaaagagtcagttttaatatgtctgaaagaaaataaatctgggngngtgtgtgtgtatgtatatatatatatatatacacacaatatatatatacacacacacatatatatacacacacacgnatatacacacacatatattatacacggngtatattatatacccaccatatataccacgggggg

SEQ ID NO: 384572 - DNA, 127 bp, Homo sapiens
ctcagggaaggaatctgagcttgtattgttggtaggcaaaggtttataaggcagagaggagtgtggtagttctattagatgtgtagtacacctggaagtagacaattaaaaacttggaacacttctc

SEQ ID NO: 384573 - DNA, 3324 bp, Homo sapiens
agccgggccccgcccgccgcagcgcggggctcctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384574 - DNA, 439 bp, Homo sapiens
tcggttttgaagtgattaaatgtcacttcctcatcagtttcacttctggaggttttcttatcctactccctggtgccagggacgtacctgggagtttgaatcaggcccatttgagcgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggcctcctgctcagactaaaggcacctcctctggcctcacccaagcctcttctaaaaag

SEQ ID NO: 384575 - DNA, 3267 bp, Homo sapiens
agcgcgtgtcccgactccggtgctttttcgcaaggtcgtgctactgcgccttctgaactacgagtcccaggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384576 - DNA, 3240 bp, Homo sapiens
agccgggccccgcccgccgcagcgcggggctcctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctga

SEQ ID NO: 384577 - DNA, 2917 bp, Homo sapiens
gctggtacggccggaattttgggatgaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384578 - DNA, 2269 bp, Homo sapiens
acccagaactgctatttaacaagtgagtctatgcagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384579 - DNA, 2190 bp, Homo sapiens
gtcgagtgaagtcctacaaattaccatgtctcctgacaagcctaatttcaggtaatgtactgatggaaacgcaggaagttcccaccctagactatcccaaagattgtgatttgatggaagcagttcatagtaatcagacccaagtcaacagagacaagatttccgtcactcgcaacccgggtttcgactgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384580 - DNA, 1730 bp, Homo sapiens
tcggaattccgggtcgaaccacgcgttcgggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384581 - DNA, 1598 bp, Homo sapiens
tcgagccggtccactctagtcaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384582 - DNA, 1426 bp, Homo sapiens
atgagatcctatctgttgctgtgtcctcaggtgtggaggaaggaaaaacagcgaggatctgcattttcaggctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttctgatttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384583 - DNA, 3269 bp, Homo sapiens
agccgggccccgcccgccgcagcgcggggctcctgcgtcccgagtgcgcggcggccggaccgggcgggcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatgtaaaaaaaaaaa

SEQ ID NO: 384584 - DNA, 238 bp, Homo sapiens
cttttgtgcatagaaatctaaatagctagtcgtggtatgtatgctggctgccaagaaagaaggaaaattaataaatgctacagggatttggatgaactgaagggtttgtggaagaggcgggatgtgagatgatcagtgggaggtcaggacaatcaaggggcatggctggggcatctcaggcagagggaacaggcaggaattcacatgccaatgtttccagaaagcgggcagtgagatc

SEQ ID NO: 384585 - DNA, 189 bp, Homo sapiens
tttctatgcctttgcttaattaagacactgtgatagactgggcagacatttcctggcaatttatgatcagctggaggagcttaagtcttaaagcaaagctgtgaaaatatgcgttatgtttatataaaaagtagtgaaattataacttttcatgtcttagctaaagttgaaaggcacattgctgtggtt

SEQ ID NO: 384586 - DNA, 479 bp, Homo sapiens
accaggcctgtggaaggattttggtctcaacaggctagactctttccagttcagagcatagaagcacagatctcactcttcgccaccttacaccataggaattcgcttctcaggaatcagggaaagatggagactagaagctttcttcctgccttctcaataactttactatcccttggaaatcctccttgatctgggagactggctgcctggtgacaagagaagagaatgaccctagtgatatcttttaggacccagcctgagctctgcttttaagggttgctggggaagcccccactgaggcatgagaaaaggaggtgctacccagctagagtggaaagggatgaggctttctctccaagcagggagcatgcctgtcctagctaactatgggggaccagccggcaaggccaagtaggccttgcaatctaggtggcgctatttctctactttttaggtcaagttcctgcaggaacttc

SEQ ID NO: 384587 - DNA, 505 bp, Homo sapiens
gatgcttccctgtgtggtcccttgtggcatagagtgccccctcttctcaggaactgtgagtaataaactatctttttagtgatggtcattcctgacctgttgggcttcaccatacctacattatttatttatttatttatttatttatttatttatttatttatttattgtgacagagcaagactccatctcaacaacaaaaaaagaagagattaggacatagacacacacagaaatgaagaccatgtaaagacatggggagaagatggccgtctataaaccagggagagaggcttgagacagatccctcccttatgaccctcagaagaaaccaaccccacccgcaccttgatcttggccttctggcctccagaactgtaagatatgaaattgatgttgtttaaggcactcagtgtgtgagactttgttatggcagccccagcaaacgaatacagagggggcctgcttccatcccagcctgggtgacagagcaagactccatctc

SEQ ID NO: 384588 - DNA, 2400 bp, Homo sapiens
gggaaacggccagagacctcgatctaagaccggggtttggagactggcgggcctcggaacagcagagctagcggacttccggtctggccctccgctcacggccgagggaaggcgggttaggtcacttgctgaggaaagagctcaatatgtcacgtgttcctctcccaatgacgtggacctcagttccctctccagtgaagtgggcacagtgttgcccgaaaaagggtgctctggggcttgcctgagacgggacgcgtggaaatgccctgccgaatatgaatggggcgatggcctcgcgggacggagcagcccaggaaagctgaccgtgggctgggttgtggagcggaccccagggcctcggctgacttagcggccagtcgtacatagtgggtatgcggcgggcccgacgccagtcgttgtggaccactgacttgtaatctttacgacctcagtgagggtcagaagtgtccgcgagccctgtaggcgaggagaggcctggctgagggcgcacagcctggaaggggagaaactagagctggactctgcttgaccctggaggccggggccctggcttctcagtcagggtctcctccccatggcggcagagctgtctggcgttttgagccctttacaccaggggcaagagggctgcaggccagagccagcaaaagagaagaagcagagggaatgagaaacctagaaggtggaacgggaaggagggagtgaaatgggcaaaggcctccaaaaaaaacaacttccgcctcctaagtttagtgcatttaactctataaatatctattgaacacctactggatgccaggcacttttctaggcactgggcagctagcattaaacaggaggcagaaacccctgccttcaacaaaatctatgctgtgttgaataagtgatacagggaaaagctaaagatggggagagaggtgggaagggtatagaggatgggaagaaatttacaaaagaggcagggagggctttactgagaaggtgacgatgaaggaagtgaaggaagggcattgcaggccaggggctcatcgtgtgcaagggccctggggtggaagggatcatgcagtggcgtgagtgtgggttgagcagcaggtgatggtcagaggtaatacgtgagccaccacgcccggcctatagtcatgattttatttatttatttattttgagacacagtctccctctgttgcccaggctggagtgcagtggtgtgacctcagctcatcgcagtgccccctgggttcaagcgattcttgtgcctcagcctcccaagtagctgggattacaggcatgcaccaccacactcagctaatttttgtgtttttagtagagatggggtttcgctatgttggctagactggtcttgaactcctgtcatcaagtgatccgcctgcctataattttttttaagtgatggggtcctgttctctcacccaggcttgagtacagtggcatgaatatggctcactgcatccttgacctcctgggctcaagcgatcctcctgccttggcccaggagttgctcgcatgagccaccacgcccagtgtattcagattttcttcgtgtttcttttctcttccgggatcccatgcaggacaccacgtcgcatttagttgtccaccacggtttttttgtttgtttgtttttttccgagacggagtctcgctctgtcacccaggctggagtgcagtggtgtgatctcagctcactgcagcctccgcctaccgggttcacgccattctcctgcctcagcctcccgagtagctgggactacaggcgcctgcccccacgcccggctaattttttgtatttttagtagagacggggtttcaccgcgttagccaggatggtcccgatctcctgacattgtgatccacccgcctcggcctcccaaagtgctgggattacgggcatgagccaccgcgcctggcccaccacagttttaattctgaagatgcagtattaagagaggaggctaaagaagcacacacttgcttaatttttccttcgttatatgctggggatggcagcagcagcttgtggctgagtttcggtgttctgcctgacgggtgacagctgagcaggcactaggtccttgcaaaacgcaggatgctggggagggtcttcaccttgcatggtgtcctgtcccacactgctcctcaggttgggagtggtggggagttactgtttaatgtgtacagaatttctctttgggatgacaaaaatgtctggaaatggatggtggtgatggtcgtagagctttacagatttacttaatgccactgaattatacacttcaaatgattaaaatggtaaattttatttatcttttgccacaattttttttaaaacctcagtaaataaaatgcaacttaaggctt

SEQ ID NO: 384589 - DNA, 2539 bp, Homo sapiens
gggaaacggccagagacctcgatctaagaccggggtttggagactggcgggcctcggaacagcagagctagcggacttccggtctggccctccgctcacggccgagggaaggcgggttaggtcacttgctgaggaaagagctcaatatgtcacgtgttcctctcccaatgacgtggacctcagttccctctccagtgaagtgggcacagtgttgcccgaaaaagggtgctctggggcttgcctgagacgggacgcgtggaaatgccctgccgaatatgaatggggcgatggcctcgcgggacggagcagcccaggaaagctgaccgtgggctgggttgtggagcggaccccagggcctcggctgacttagcggccagtcgtacatagtgggtatgcggcgggcccgacgccagtcgttgtggaccactgacttgtaatctttacgacctcagtgagggtcagaagtgtccgcgagccctgtaggcgaggagaggcctggctgagggcgcacagcctggaaggggagaaactagagctggactctgcttgacccacagaccctccgccaggttgcctttgcgaggcaagaagcgaaggttggcgagccagctgggagtacccaccccctccatgcctggtggagtcacccaagccccagcgacaccccggcctgcccaaggtactggtgaccctggaggccggggccctggcttctcagtcagggtctcctccccatggcggcagagctgtctggcgttttgagccctttacaccaggggcaagagggctgcaggccagagccagcaaaagagaagaagcagagggaatgagaaacctagaaggtggaacgggaaggagggagtgaaatgggcaaaggcctccaaaaaaaacaacttccgcctcctaagtttagtgcatttaactctataaatatctattgaacacctactggatgccaggcacttttctaggcactgggcagctagcattaaacaggaggcagaaacccctgccttcaacaaaatctatgctgtgttgaataagtgatacagggaaaagctaaagatggggagagaggtgggaagggtatagaggatgggaagaaatttacaaaagaggcagggagggctttactgagaaggtgacgatgaaggaagtgaaggaagggcattgcaggccaggggctcatcgtgtgcaagggccctggggtggaagggatcatgcagtggcgtgagtgtgggttgagcagcaggtgatggtcagaggtaatacgtgagccaccacgcccggcctatagtcatgattttatttatttatttattttgagacacagtctccctctgttgcccaggctggagtgcagtggtgtgacctcagctcatcgcagtgccccctgggttcaagcgattcttgtgcctcagcctcccaagtagctgggattacaggcatgcaccaccacactcagctaatttttgtgtttttagtagagatggggtttcgctatgttggctagactggtcttgaactcctgtcatcaagtgatccgcctgcctataattttttttaagtgatggggtcctgttctctcacccaggcttgagtacagtggcatgaatatggctcactgcatccttgacctcctgggctcaagcgatcctcctgccttggcccaggagttgctcgcatgagccaccacgcccagtgtattcagattttcttcgtgtttcttttctcttccgggatcccatgcaggacaccacgtcgcatttagttgtccaccacggtttttttgtttgtttgtttttttccgagacggagtctcgctctgtcacccaggctggagtgcagtggtgtgatctcagctcactgcagcctccgcctaccgggttcacgccattctcctgcctcagcctcccgagtagctgggactacaggcgcctgcccccacgcccggctaattttttgtatttttagtagagacggggtttcaccgcgttagccaggatggtcccgatctcctgacattgtgatccacccgcctcggcctcccaaagtgctgggattacgggcatgagccaccgcgcctggcccaccacagttttaattctgaagatgcagtattaagagaggaggctaaagaagcacacacttgcttaatttttccttcgttatatgctggggatggcagcagcagcttgtggctgagtttcggtgttctgcctgacgggtgacagctgagcaggcactaggtccttgcaaaacgcaggatgctggggagggtcttcaccttgcatggtgtcctgtcccacactgctcctcaggttgggagtggtggggagttactgtttaatgtgtacagaatttctctttgggatgacaaaaatgtctggaaatggatggtggtgatggtcgtagagctttacagatttacttaatgccactgaattatacacttcaaatgattaaaatggtaaattttatttatcttttgccacaattttttttaaaacctcagtaaataaaatgcaacttaaggctt

SEQ ID NO: 384590 - DNA, 711 bp, Homo sapiens
atctatcaaatcttattgtactttttaatggaaaatgttcatatttatggtgttaagataatagtcttatgttggcatagcatttttctttttacaaagcttccttcttccctcccctcccctcccctcccctcttcttcccttcccttccctccttctttccttccttctctttattaaattgagatggagtctcactctgtcacccatgctggagtgcagtggcacaatcttggctcactgcaacctccacctcccaggttcaagtaattctcctgcctcagtctcccgagtaggtgggactgcaggtgtgcagcaccatgcctggctaatttttgtatgtttaggagagatgaggtttcaccgtattgctcaggctgttctcaaactcctgacctgaggtgacctgcctgcctcggcctcccgaagtgctgggattacagtcgtgagccactgcgcccggccttacaaagcactttcatgggtgctgctcattcagtggtgtggtttagatgtcttttgtattcacctgttactttcattttttttttgtttgagacggagttttgctcttgtttccaggctgcagtgcaatggtgcgatctcagctcaccacaacctctgcctcccgggttcaagcgattctcctgcctcagcctcactagtagctgggattacaggtgcccgccaccatgcccggctaattttttt

SEQ ID NO: 384591 - DNA, 449 bp, Homo sapiens
tcccagctactcgggaggctgaggcaggagaatcgcttgaacccgggaggtggaggttacagtgagccgagattgcgccattgcgctccagcttggcgacagagcaagactccacctcaaaaaaaaaaaaaaataaaccacaacagactgtcatgataggttcacttcaccctgtggttaatgagttaatccatataaagcagtggtctccaacctttttggcaccagggaccagttccgtggaagacattctgaaaggggctggggattgtgtagggggttgtgtgttgtgccactccagcctgggcaacatgagcaaaagtctgtctaaaaaaaaaaaaaattactgcactatgccagattgttcaataaaagccatagagattatgaaaaattggagttaggtgtgcaaaaactgcattagttactcatcaccaaaaaaaaaaaaa

SEQ ID NO: 384592 - DNA, 769 bp, Homo sapiens
gggagaccactgggagcagctcatccctggcccctgctttgcacgtggcagagccctcctgcacagccagctcctcacccccgtggcgcgcacccccaacgaaagtggctgtgatgagccccacagccctggcgttgcccactccttctgccacgtcccagggcccacgggcccacatggtgtgtgacatcccagtgccccgcgtgcaggcaaggcacacctgaagcgtgccatcctggggcaggaggaggcgctgcggctgcacgccctgtgccgcgtcctgcgcgaggtggacctgcttcgggctgtgatctcccagacgctgcagcgctcactggccaagtatgcggagctcgaccgtgaggatgacttctgtgaggctgccgaggccccggacatccagcgtgagcagccagggcctgtctgggtggctgcatccctggccagggtgggggccttcgtcctggagaaagggaggctgattgcattaaagatgcagtcaccacgatgaattaaacagcagtagcactttccaggccacgatcacagggacccacagagctgctgggcccttcaggggcctgggggatgaccacgctcctcagcacctccctccctgcactggcctcctaccctgaggggaagcccacagacccaggacaggcatggctgggacttcagggagggattttgggagccacttggggcagagggggccgtgtgttcagggcacacctggggcagctcctcccaccattgcagagtggcc

SEQ ID NO: 384593 - DNA, 473 bp, Homo sapiens
cttcaagccttcttttcctccattatgaaatggggaaagtaatagtatctacttacagtagatatcccatgagcatttgttggaaaaaattgtgtctactaagtgagaatcttaataagtaaaatgaagttacatttattgatctcctcctctatgccaggcacggagcttagtgtttcacatacattattttcatttctacaacaactgtcaaggtgggggaaacaagcagttataatacaacgtggtaagagctatactagtggcacctgcaaactgtgatgagaacacagtggggaggcattagctttttctagggaaccccatagagacttcacagagaagatagggaagatttcataacaacaataataataacagcagtagctaacagccatggagaactcattcagcaccaggccctgagccacaatacacgccttcagtcaacgagcactccctgagccttcctc

SEQ ID NO: 384594 - DNA, 980 bp, Homo sapiens
tgggtgtgatctcagctcactgcaacctcctgggttcaagtgactctccggcctctgcctcccgagtagctgagattacaggcacccatcacaatacctggcaaatttttgtatttaaaaatacagccaggctcggtggctcacgcctgtaatcccagcactttgggaggccaaggctggcggatcacctgaggtcaggagttcgagaccagcctgaccaacatggtgaaaccccgtctctactttaaaatacagaattagctgggcgtggtggctcatgtctgtaatcccagcactttgggaggccaaggtgggtagattgcctgaggtcagttcgagaccagcctgaccaatatggtgaaacctcatctctactaaaaatacaaaaattagctgggcatggtggtatgctcctgtagtcccagctactcaggaggctgaggtgggagaattgtttgaattcgggaggtggatgttgcagtgagctgagatcgcgccactgcactccagccgggcgacagagcgacactccgtctcaaaaaaacaaaaacatacaattttaaaaatttagtcttagcttttcaataagagggattaaaatatattattttagtctgctcagcatccattctcccttccttttggcaaagaaccctaaattttttgggggatgatatagtttggctgtgtccccaacccaaatctcatcctgaattgtagctcctataattcccatgtgtcatgggagggacctggtgggaggtaattgaatcatgggggtggttaccttcatgctgttctcatgatagtgagtgagttctcaggagatctgatggtttcataaggggcttttccccttttgctttgcacttctccttcctgccatcatgtgaagaaggatgtatttgcttccccttctgccatgattgtaagcttcctgaggcctccccagccatacacaactgtgagtcaattaaacc

SEQ ID NO: 384595 - DNA, 416 bp, Homo sapiens
aatctgaaatttattccactgaaaaatatatggctgtatgtggaaatgctaactatgaggaaataataaaaaataatctaaatattaacacaaacatattaaaataatgtactcaacattataatgttgcaattaaaatataaagtattagtaactgtagtattgttagtagataaatgcctcacttgttatacctgcttatgagcaataatcatggaagtgatttgtgtttgttttttttttagtcaacttaaaatgtggaaattcaactatgtttgctttgccagctagcacctgttagaataatttaggagttttggtggcaggcctatagtctcagatgctgagaggctgaggtgggaggagcccaggagtttgagtccaggagtttgagtccagcctggcaacatagcaag

SEQ ID NO: 384596 - DNA, 458 bp, Homo sapiens
agcagggattctaaacactttttctgtatgaattcactaaatcctcatagccaccctaagacagagctactacttttatccccattttcatatgagtaaactgaggcacagcaaagttaagtaacttggctaataaccagaggatgggaagaagaggagctgctgtggagaccttgccattttggctccaggctttggctcttaatcccttagacgagcctcttttaagtctcctccctgctcattgtcctctcagtttcttgccaggcacggtggcttatgcctataatcccagctctttgggaggccgagacatgtggatcacttgaggtcaggagttctacaccagcctggccaacatggtgaaaccctatctctactaaaaatacaataattagccgggtatggtggtgcatgcctgtaatcccagctactcgggaggctgaagcatgagaatt

SEQ ID NO: 384597 - DNA, 4207 bp, Homo sapiens
gggcaatcatggtgccgctggggaggggagaagctgctgctgccgccgttgccgggagccgcggagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatgaggtggcatgtaattggcaggccaggtgtcctggttccaggttccagccaggctttgggttgccccctccatctctgcccccctctggattttgcatacagcctcatacagtgcaaacaaggatgtgacttgctcagcttagtcatgtgatttatttaaaaaaaaaaaaaaaagaaacacaaaacgatgatcttctactcagggtatagcaaaacaaaaaaattccctttccaccaaaaagcctgaaatgttgcaataagttatctcatttggaatgtttcattaagttgtgttataggaaaaaattgtgtgtgtgtgttatagaattatatccatatgtctgcctttggctccaagtcattgcctcttaaaataaaagatacaatccatactagcatgaaaagtttccctcaacaggctatattaacatagtcatgagtgctgaccaaactcaccgagctcagaggccaggcatggcctgaggtgcagaataggcctctgcctcccaagagccctttccttgccctgagcaaggagtggtgttccacaaacaaggctgctcttctaagccaacagtgtcaggcaggaagcagccataattttgccttgcattttcattccctaatgtaaagggatctgcattggtcactctcctgttctctgagccattgctcagggccagccaagatattattgagaacagataatttaccttggagccagaggccctccctgcctttagcaaggatgttcagggacagacaaagagggcagtggtggtgaatgttgttactgccatgaggagaaatggcagtaagaaatcttaactacaagcagccaatttctcattccaggaccct

SEQ ID NO: 384598 - DNA, 470 bp, Homo sapiens
aacttcccattagtcagaaagtatagtcactagtcatgtcaaaaaaaggatgtttagtctcttttccagaaaagccttaagacacttttttaaatggttagaactatattgggtcttcacatttaggaagtgaggttgatggtgaaacgtgatactttgaccagaggtgtcactaaatgaaaatgacagaaagctggcctgctagctatgaagagatcagctcagtggacttcagctgtgttttgtttagcccataatgactgtttttgtggctcatctaaggcttgggatatgtatatatatttctatttctttttcttgccagcttccttgactgaaagttttaatggtgatgcagagtcagtcagtgatgttccgccatccacaggaaattcagcatctttatctcttccacttgtactgcaacctggcctctccgagccaccccagcctctactacctgcctcagc

SEQ ID NO: 384599 - DNA, 4202 bp, Homo sapiens
gttgtttgtgcctgattgaggaatagcccttccacccagaaggttgaaacatctgttctagacaagtcattacgttttcatttctcacaactgggctgagcacaactgaaccatgggggaacacagtccagacaacaacatcatctactttgaggcagaggaagatgagctgacccccgatgataaaatgctcaggtttgtggataaaaacggactggtgccttcctcatctggaactgtttatgataggaccactgttcttattgagcaggaccctggcactttggaggatgaagatgacgacggacagtgcggagaacacttgccttttctagtagggggtgaagagggctttcacctgatagatcatgaagcaatgtcccagggttatgtgcagcacattatctcaccagatcagattcatttgacaataaaccctggttccacacccatgccaagaaatattgaaggtgcaaccctcactctgcagtcggaatgtccggaaacaaaacgtaaagaagtaaagcggtaccaatgtacctttgagggctgtccccgcacctacagcacagcaggcaacctgcgaacccaccagaagactcaccgaggagagtacacctttgtctgtaatcaggagggctgtggcaaagccttccttacctcttacagcctcaggatccacgtgcgagtgcacacgaaggagaagccatttgagtgtgacgtgcagggctgtgagaaggcattcaacacactgtacaggctgaaagcacatcagaggcttcacacagggaaaacgtttaactgtgaatctgaaggctgcagcaaatacttcaccacactcagtgatctgaggaagcacattcgaactcatacaggggaaaagccatttcggtgcgatcacgatggctgtggaaaagcatttgcagcaagccaccaccttaaaactcacgttcgtacacatactggtgaaagacccttcttctgccccagtaatggctgtgagaaaacattcagcactcaatacagtctcaaaagtcacatgaaaggtcatgataacaaaggacactcatacaatgcacttccacaacacaatggatcagaggatacaaatcactcactttgtctaagtgacttgagccttctgtccacagattctgaattgcgagaaaattccagtacgacccagggccaggacctcagcacaatttcaccagcaatcatctttgaatcaatgttccagaattcagatgatacggcaattcaggaagatcctcaacagacagcttccttgactgaaagttttaatggtgatgcagagtcagtcagtgatgttccgccatccacaggaaattcagcatctttatctcttccacttgtactgcaacctggcctctccgagccaccccagcctctactacctgcctcagctccgtctgctcctccgcctgctccctccctaggacctggctcccagcaagctgcatttggcaacccccctgctctcttacaacctccagaagtgcctgttccccacagcacacagtttgctgctaatcatcaagagtttcttccgcacccccaggcaccgcagcccattgtaccaggactttctgttgttgctggggcttctgcatcagcagcggcagtggcatcagctgtggcagcaccagccccaccacaaagtactactgagcccctgccagccatggtccagactctgcccctgggtgccaactctgtcctaactaataatcccacaataaccatcaccccaactcccaacacagctatcctgcagtccagcctagtcatgggagaacagaacttacaatggatattaaatggtgccaccagttctccacaaaaccaagaacaaattcagcaagcatctaaagttgagaaggtgttttttaccactgcagtaccagtagccagtagcccagggagctctgtccagcagattggcctcagtgttcctgtgatcatcatcaaacaagaagaggcatgtcagtgtcagtgtgcatgccgggactctgcaaaggagcgggcatccagcaggagaaagggctgctcctccccaccccctccagagccgagcccccaggctcctgatgggcccagcctgcagctcccagcgcagactttctcttcagcccctgttcccgggtcatcatcctctaccttgccctcctcctgtgagcaaagccgacaagcagagactccttcagaccctcagacagaaacattaagtgccatggatgtgtcagagtttctatccctccagagcctggacaccccgtccaatctgattcccattgaagcactactgcagggggaggaggagatgggcctcaccagcagcttctccaagtgaagggcccatgtgtgctcacctctgggaaaagcgggtgagcaggaggcatgaggtacaatgcctgccatcatgggtcagaaatttgaaggatgaagaaatctactgtttgaaatcctcacctttcagacgtattttctttattcacatcccaggagcatccattttaaggaactattctttggaaaaaaacaaaaaacaaaaaaaacaacaaaaaaagctaagttataagtgaactgtttggctgcactgtatgtcacttttgcttgttgtcatgtgaacttggaaactaaggttactcgtgtgcataaaaattctaaatgaaagggtgtggtttccatcaatctgatgctgcccatcgcttgcactggggtctttgtggatcgggcaggagttttcagtgtgttgggtgttgctccttcctatgtgtcttttgaatctgaggctgacatttgcttggaaggccagacccttgctccatcagagagggcagtggcaaaggccagtgaggcagctgtgagttggacagggttcaggtgagatggtgttgtcatttgtgcttagtgttggtggtgctcagggtggataacacgggtcgttctgcagcccgcttcagcacaaataggcagcttaaggcctggctcacaggctgtggggttgatctggctctgcagaggccctaggcagcttgttgactgctgtctgttgatgacgtgtgtgcaaagcaggctctagcaacatgatcactgtccttgccttcctggttctttctctcggttggttgccagggcttgcagatcgcagtgaattttccttggggaacatcgctgttttgtcctagagtgaacttgtggcttatggccagtgctgtttggtggtctgccttctttttaatggtattttcttcctcagagcagaagggctgcattttgcttatcagaagaaggtgcagatttaagggaattcatatgaggtggcatgtaattggcaggccaggtgtcctggttccaggttccagccaggctttgggttgccccctccatctctgcccccctctggattttgcatacagcctcatacagtgcaaacaaggatgtgacttgctcagcttagtcatgtgatttatttaaaaaaaaaaaaaaaagaaacacaaaacgatgatcttctactcagggtatagcaaaacaaaaaaattccctttccaccaaaaagcctgaaatgttgcaataagttatctcatttggaatgtttcattaagttgtgttataggaaaaaattgtgtgtgtgtgttatagaattatatccatatgtctgcctttggctccaagtcattgcctcttaaaataaaagatacaatccatactagcatgaaaagtttccctcaacaggctatattaacatagtcatgagtgctgaccaaactcaccgagctcagaggccaggcatggcctgaggtgcagaataggcctctgcctcccaagagccctttccttgccctgagcaaggagtggtgttccacaaacaaggctgctcttctaagccaacagtgtcaggcaggaagcagccataattttgccttgcattttcattccctaatgtaaagggatctgcattggtcactctcctgttctctgagccattgctcagggccagccaagatattattgagaacagataatttaccttggagccagaggccctccctgcctttagcaaggatgttcagggacagacaaagagggcagtggtggtgaatgttgttactgccatgaggagaaatggcagtaagaaatcttaactacaagcagccaatttctcattccaggaccct

SEQ ID NO: 384600 - DNA, 265 bp, Homo sapiens
gccctcactcgctaccagatgctcttcaggcacatgttctactgcaagcacgtggagcggcagctctgcagcgtctggatcagcaacaaaaccgccaagcagcactcgctgcactccgcccagtggtttgctggggctttcactctgcggcagcgaatgctcaacttcgtccagaatattcaatactacatgatgtttgaagtgatggaaccgacctggcacatcctggagaaaaacctgaaatccgtgagttttagctccacag

SEQ ID NO: 384601 - DNA, 283 bp, Homo sapiens
aagatttttcaaggaattttcttctctataatataattaatgatctcctacttggacttctgtaaaagattacagtaaatcgtgaagtcttatggaggtttttgcgggagtgggtgggagtagttgtctattactgcgtctttgaatctaaaacagtaccaggatggggccagagggcatctgggctcttcacggattatataggcttgaccttgttagtactgcatgctgtcagagcctcatccaaaaaccactgagatgtttttgtgcaggggaaataaaa

SEQ ID NO: 384602 - DNA, 459 bp, Homo sapiens
aaagagcgccggaccgcttagggaacggcaaggaggcagaggagcagatgaggttggtcactttggcttttcctccgatttgtttaattctcatgttgtatttccctcctaaatgtcagctttggggctgtagctctgcttgtctttactgcagtgacccccctgcaacactgtctggcacacactaggcgctcaaacattatttgttgaatatgtgaacgaagggatgcagagatggttggaaccctccagtcgggcctgggtgccaggtcctgggggcagtcgttccagggatagactgaggcctcggcagcccctggaacctcatttcggtccttgtcccggagtcgcacgtcccgggatagcgccgctgcagcgggtgccgcccgtgcatcgcgtcggggggatttccgacggagcccggagtccaggggcaggaccgcccgcgccccgcccggc

SEQ ID NO: 384603 - DNA, 773 bp, Homo sapiens
cagcgttagccgccgcgcgagggcgcccgggaggctggggccggaaagcggaaccgagagcgctttccgccgtgcggcgatgaacctccgggaaagacgctgggaggcccagggatgcccggcgcaactggacgctcatcgggagtcacggggtcggccctcaggggaacggggactatccgtatcaactcggtgtttgttcgttttcttcaccttgcggtttgtgccctctccacatttcctctctgtgtctaccattctcctgggggacgtggcaaaccgtgagccgctgcgtttgagttttgggaaaccctgcggaaacgccctggcgccggtggttttgcgcgtcctaccctgtgtcacctcagggttatgatctggcccctggcaaggctccccaagtgtgatgcctccccccgtccagatgactgcattttgaggatggagtcagtctggtggcattttttgcttaagtaaacaattgtaaccgtttgtgtagcatcagcgttcaacagctgcctgtgcaaatcgaaaaaagcgaaactttggaaactaggaagcatcagatgaataattctgaagacttgatgtcaacgggagtatcttgtttttaaacttttggttttctgttctggagacaaacagttcatatgcactaaagaaaaaagtgtcattatttcagatgctcattgccagcaaagagaactgtattgcaagtcaggcttcactcccagtattttctgaatgtttcaataaaatgaaatatatacgtc

SEQ ID NO: 384604 - DNA, 585 bp, Homo sapiens
cacccagctaatttttgtatttttttttagtagagacggggtttcaccatgttggccacattgatctcgatctcctgacctcatgatctgcccacctctctttgcatttgaagttcatgacgaaattaaaatattttaaaaatctaagtatgtaataagaaataaaaactggtttttatttaggaatttatgaaaattagtcttgataatgtatactgtttattattaagtagggtcttaggtttctaagtgtatttatgaaaaccttttatagtaaaaagtcctcaatatatcttttattttaatgtaaccattaattcatttgtttagtaaccatttagaccaaactgtgactcaaaagaataagacaaattcactgttaaaaacctcacttactaccaggagataaagtaggcaagccagtggctgagaaaatgtagtgtggttcttttgaatatgtgacattgaacgtcccaaggatgttggacaccatcctttatatggagcttggtaatgtaatttggtaatatagtttgggaatgtaatttggttcaaggtgatggtggggcttgagggtaagaccaa

SEQ ID NO: 384605 - DNA, 447 bp, Homo sapiens
tgctcagagtatttgatataacttggccaattggtttctgcgtctttcatttccacagcattcttgctgaatagtcagatttctaccatatttccctaatttctcttatacctctctccacttgaaactatttacaagcatgactagcataatcttgtaaatatactttggtcatgttaccacatcataaatcttcactggttcttgttcattagaaggtaaattctaaagttcttggcttgctattcaaggttcctccttcctgttttgcaagctacttttttatccttatcatctctgcactacagatcctctgcttctaccaggattataccagagtgctagaattccttgtccctcagggattacgactgaaagaaatttaagaaagttgaaaaaattgaggagtgacttttttctaggttaaatagcataatcaggtctcct

SEQ ID NO: 384606 - DNA, 1221 bp, Homo sapiens
tcaattttatttctgtgtatgtaaaaagaaaggcttcatatctaaaataactttacctaagtatacaaagttgtttcagggtaacaaaagagcgaaaaacaaaactgtaaaagggccaaggacagaggaatgggcaaatgaaggaagggcggagaggcagaacaagagctgaaggagaaaattctgtggaggggtgtgggaaaggggtggagctggcaaccttgccttaaaagctgagtgatagcccatactaaagactggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgcc

SEQ ID NO: 384607 - DNA, 1285 bp, Homo sapiens
tcaattttatttctgtgtatgtaaaaagaaaggcttcatatctaaaataactttacctaagtatacaaagttgtttcagggtaacaaaagagcgaaaaacaaaactgtaaaagggccaaggacagaggaatgggcaaatgaaggaagggcggagaggcagaacaagagctgaaggagaaaattctgtggaggggtgtgggaaaggggtggagctggcaaccttgccttaaaagctgagtgatagcccatactaaagactggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcaggtgattttattcaaacagtctcactgggaatctcaccggacggagggaaagcactgagaacaggaagctgcttcacccgagagttccttggtgccctttccaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctgaaaagccttt

SEQ ID NO: 384608 - DNA, 1040 bp, Homo sapiens
cttaaagtaatatctttttcaagggttactattacaactcataatatcataaatcatagcaatggaagaaaatgacttaactaagaagaatccaagaaaatgaccactagctgtggtcaaactgttttcagtgacttacatgacttcagaaagatgacagattaatgtcagggagagtcaaaagtactatgataaaagcactgaggggatcatgaagagagacgagagaggaccaatggggtaaagcagagccttggtaaaattatggtactttaaggtgtccaactgtaagtaagctaagtgtttagatattaggatgcttgcttattttgtttcaatgtttaatttatactgaggcaatgcttttttgtctatgcaaacattcatagtttttctgagtgctctttgacatgaatataccctcacatacacctttttttttaaatttaacagaaattgtgccatccttcatcaacaaagatacagaaaccataaatatgatgtcagaatttgttgctaatttgccacaggagctgaagttaaccctgtctgagatgcagccagcattaccacagctacaacaacatgtacctgtattaaaagattccagtcttctctttgaagaatttaagaaacttattcgcaatagacaaagtgaagccgcagacagcagtccttcagaattaaaatacttaggcttggatactcattctcgaaaaaagagacaactctacagtgcattggctaataaatgttgccatgttggttgtaccaaaagatctcttgctagattttgctgagatgaagctaattgtgcacatctcgtataatattcacacatattcttaatgacatttcactgatgcttctatcaggtcccatcaattcttagaatatctaagaatctttgttagatattaggtcccatcaattcttagaatatctaaacatctttgttgatgtttagatttttttatttgatgtgtaagaaaatgttctttgtgtgattaaatgacacatttttttgctgaaaagccttt

SEQ ID NO: 384609 - DNA, 916 bp, Homo sapiens
tcaattttatttctgtgtatgtaaaaagaaaggcttcatatctaaaataactttacctaagtatacaaagttgtttcagggtaacaaaagagcgaaaaacaaaactgtaaaagggccaaggacagaggaatgggcaaatgaaggaagggcggagaggcagaacaagagctgaaggagaaaattctgtggaggggtgtgggaaaggggtggagctggcaaccttgccttaaaagctgagtgatagcccatactaaagactggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcaggtatttccagcagtttgctgagaagaagactttttgaagatcacgatggcccttcatttcttgtttgattcttctggataaagcagcatgataacctgaaaggaaagcataaacatctggagcagttccaaaggcatctggggagagtcagcactggaggcttgaataaaagtgtttacttcttcttattctccaaatctcaatgaaataataatttaaaaaaaaaactagaaaaaaaacagatccaatgtagcaccgactgtcattgggatcaggtatgagttgcctgttgttgacagatcatgggaaacaataagaa

SEQ ID NO: 384610 - DNA, 801 bp, Homo sapiens
ctggtccctaaagtttgggcttttcctttgccaggtgattttattcaaacagtctcactgggaatctcaccggacggagggaaagcactgagaacaggaagctgcttcacccgagagttccttggtgccctttccaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccactttaaccatacataataacaatacagtacctaacaacagt

SEQ ID NO: 384611 - DNA, 1263 bp, Homo sapiens
tcaattttatttctgtgtatgtaaaaagaaaggcttcatatctaaaataactttacctaagtatacaaagttgtttcagggtaacaaaagagcgaaaaacaaaactgtaaaagggccaaggacagaggaatgggcaaatgaaggaagggcggagaggcagaacaagagctgaaggagaaaattctgtggaggggtgtgggaaaggggtggagctggcaaccttgccttaaaagctgagtgatagcccatactaaagactggttgagccgggtagggaaagcagcctaaagcccgggacaggcacacaggcccaggtgtgtaggccacagcagccgcagtcctgaaaggctgcaacacccagacctccaggagagaccaggcccaggatgcctcgcctgttcttgttccacctgctagaattctgtttactactgaaccaattttccagagcagtcgcggccaaatggaaggacgatgttattaaattatgcggccgcgaattagttcgcgcgcagattgccatttgcggcatgagcacctggagcaaaaggtctctgagccaggaagatgctcctcagacacctagaccagtggcagaaattgtaccatccttcatcaacaaagatacagaaactataattatcatgttggaattcattgctaatttgccaccggagctgaaggcagccctatctgagaggcaaccatcattaccagagctacagcagtatgtacctgcattaaaggattccaatcttagctttgaagaatttaagaaacttattcgcaataggcaaagtgaagccgcagacagcaatccttcagaattaaaatacttaggcttggatactcattctcaaaaaaagagacgaccctacgtggcactgtttgagaaatgttgcctaattggttgtaccaaaaggtctcttgctaaatattgctgagatgaagctaattgtgcacatcttgtctaattttcacacatagtcttgatgacatttcactgatgcttctgtcaggtcccactaattattagaatataagaaatctttattaatgtttagatttttcatttggtgtgtaagaaaatattctttgtatgattgtagtttctgtaaatgacactttctatgctgaagtctttttgtctttttattaacagtataattgtgttgattctttttaatgctgttaacttaaaattacaataaaacctttgccactttaaccatacataataacaatacagtacctaacaacagt

SEQ ID NO: 384612 - DNA, 1378 bp, Homo sapiens
acttgggcaggtccctgggaagcagaatctgagatagcgggagactagtgtgtgggttctaataagttagagcatgctcttggggtccacacgtgttgaatggaagggaaggaagaattgggctgaaggagaaattgggttgtagcccagtctcaatgaaggctatcattgacccagtaagacctctggagctgggatggcccttccaagttgcctggagttgtgttgagggggctgggcctttagatccacatgttggccacttattaggtattggctgcccctgggaggagggcatgaccttgggcaaagcaggtgtcttcagagagatggtctccaagacagctgagggctgtcaccattagcactctcggagctgggagaagtccctgagccctgaagggtgttttgggcagtatgtgacagtgctcacagcaggggaaacagcacttccccagaatgcagccgatgcataagatctgttggggcccaacacccttaaggaagaagcatggatgtgtgcaaacccagctatccctggaattgaccctgggtgtcttgtggtttcaaaatctgctcatcaacctccatggcctttatattccaggaaaaaaatctaggcacaaaattgttggtgaacatgtacttagaaacaatccttcctccacccaatcagttcatcaaccacccaggaactggtaatccattgaaactaccctttctcaccatcccttacccacctaatgtcctcacttgccaggatgaggatgtgtggtccatcactacagtaaccgccagagaacactctcaaacccatttgtttaaggcactgtccacccccagttcagtttgtcaccttcgaggaagaggctctgttccttttgttcatgttgtttcctcatcatcagatcttggggatacaaagatgacaggtcataacccccaactcaatgaaaacaccacctctttggagaaaaaaacaaaacatttcatgttagtaagaataagcactaattgatgcagttcaaaaggctttgagagaaaactctgtcatctaatggtattatctaggaaggtggctctttttcctgatctaactttttttctttttttgctgccttctggagtgttagcagcaggaataaatgtaacctgtaagtgaatgaagaagcttgcttccatactgtcctggctgaagagtcgttgagtactgggtttttcaattactggagcttgctgctaaagtagaatgaaaaaggagaactgaattcttagaaatgggatgtttgaagcctttgtagaaatctgacaggcatcctcaaagttaaaagcaaaagatctcagtttcaataaaagggtcagtggtgccataaccatt

SEQ ID NO: 384613 - DNA, 395 bp, Homo sapiens
tatcaaatccagttaatcatgttgttagcaaaatgtacttctactagaaggtatttaaaggaaaatgatttacagatactaattaagaaaatgtaacaagtcaaatcagcactgaaacatggctcaataaaatttgggatgtatgcataaaatacactgttttgaaatgtgaacctcaaacagttaaatactttcttttttaaactatgaagtattcatgattaagaaactagctaggttcaccgggcgcagtggctcacgcctataatcccaccactttgggaagctgaggtgggcagatcacaaggtcaagagatcgagaccatcctggccaacatggtgaaaccccgtctctactaaaaatacaaaaattagccgggcgtggtggcaggtgc

SEQ ID NO: 384614 - DNA, 210 bp, Homo sapiens
tttaaaattttccatttggggaaacttgtacatttaaaaaaaattcatctcattttctccctccccctccttaaaataaataagaaggcttaagaattaacactaataataatcccacaatggtcattgggaaatcctcccccaaagtgacaactgccgctaagaagggcaaaatccactaagaatgaaaattcccccaaatgagtcctt

SEQ ID NO: 384615 - DNA, 524 bp, Homo sapiens
caggtaaatgtatgcactcatgaaacggtgtcagtaaactctcctcaggttgtagaaaagaggacatagaagcctgaaccctgctgtctactcatttccttaatctaacagactatttatctattctgaagcatgtgtgagatagcacatttattttcctgcaaattaaggtatcagcctagcctatgtcccttatcaatatctgcccccacctccacatgacactgagaccaccagtggtcctaaagatggaatgaattccaagtctaaagtcccatatccaacccacatttatttcaactcactttttaaaaataagcaaagttttagagaacagacattttagtgagataatagaagttaaagggtggtcatggagggacactttaccatgatccggacctggaaaactccaggtgaacaagtcggaatagaagaaataacctgtgccacagctcacccagagaaaaagccaggaggatgactaagcaggcagtaaaatggattgttaatggctcagaacc

SEQ ID NO: 384616 - DNA, 94 bp, Homo sapiens
gatcacttgagcccagaagtttgagaccaccctgaccaacacagtgaaaccccatctctaaaaaagtttgtttttaaagtctccttgaaacatc

SEQ ID NO: 384617 - DNA, 506 bp, Homo sapiens
agtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctca

SEQ ID NO: 384618 - DNA, 641 bp, Homo sapiens
  misc_feature (233)..(233): n is a, c, g, or t
  misc_feature (240)..(240): n is a, c, g, or t
  misc_feature (285)..(285): n is a, c, g, or t
  misc_feature (321)..(321): n is a, c, g, or t
  misc_feature (368)..(368): n is a, c, g, or t
  misc_feature (372)..(372): n is a, c, g, or t
ggtaaaagaattttattattatgtggcttaggtaggtttttgcattctactaacagaaaagcattttccacaccttattcaacctaacacattatacatttgtgattttatctacatcgctgcagtattacactattgaaaaccttcctttcaaatgtactttggtgcaattatacagtagatatctctgccttcagaaaataaaaatattctcaatctaaactcaaaatggnataaagncatcaataccaagtttgtgcaccacttggtaaaagattgcaatanaagtcaggtagtgtatggttgctttgcatttagggnggttgaggcatctggccacaggtttctagtcaaacctgttgtttggnatgnttttcccatgtatttctgggttctgcacacgtgacctcagtggttgaaataacaagggcagccggcagtgacttagagacacgagactggctgctaggcagcttgcaatctggtgacttcattctgggatcctgggaggagtccctgccaggcccagctcccctgtcaccctagttgccagctccagccagtggccagacagcaatcatccctgcccctccctttgcccacgtgctggtcgtccccctgtctgggacagcagctggggc

SEQ ID NO: 384619 - DNA, 306 bp, Homo sapiens
aggaaccccagcctttcccagaaaaaggtctgacttccacaatcaccgggctcaggctcaccgcccccagcttctgtctccgccaacccgttctgacccactcactgctaaatgcctgacaactgctcaaaagctctactctgacaatgaggcagcttggcttaaacttctccacggtgaagtccaggatccccagcagggccttcgaggctgtttgtagcccctgccaacctgtcccccacctcccaccccagcccacatgcagtgaccacagctgaccactgcccatcatgcgctcccacaccc

SEQ ID NO: 384620 - DNA, 506 bp, Homo sapiens
cagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtgtgtaactcagtaaatattcaatgaatgaatgaagaaattcagaagataa

SEQ ID NO: 384621 - DNA, 459 bp, Homo sapiens
ttctgggagttcttgctcaacatcaagaaacttccaccaggatccacggggggaagtggaagcagccttgtgatagcagtttcaaaggcctgggctctggcaaataggaaaaaacaggctgagaaaacatatcaggcaggcctgcttgtgagggaacctggcagacatccaaccagcagtctggtggccaattcggtacatcagacatgcgcttaatccatcattcggcagcgggcaggtcactggccacacaggcttcagacctcctggcttgagggaacttggggttgccatcaggcccgtatgaatcagaaattctgggcttctcatcccccaccaggcactcccacactgtccctcctctgcatgtttgcctctccattctctctaccttcactgtctcggttgcctatggtcacagtgatactcaataaaccaccaaatccagtggcttaagag

SEQ ID NO: 384622 - DNA, 265 bp, Homo sapiens
ttgcttagcaacggagctagcaagacaaaaatacttcagttggcatctcccttaaagcacatccccaaacgcgggtcctggccccagacagggagaccagggctctgacagtggcaggttcttccctctggaaaaagaatagaagaggagctcctccctaacccactggttcccagggcagaccctgggaggaggtgctgaaacacagaagagagtgtgtcttccccaacctccattccacaggagagaaactgaggtgaggggt

SEQ ID NO: 384623 - DNA, 724 bp, Homo sapiens
gttgttacttccactttatttgcagaaatgttccttattctctagaaaacattatgcgttggctgacacactttcagtgggattcgttttagaaaatgacatgtgaccctgatactatttgacaggctccatggcagcaaggggcaggcctgggcttacggctcagcagatgaatccaggggggtggacttgcaaggactctggagggctctagcttccctgtcattttaaagatggagaaacacaggcctggagaaaggaagaaataaacccagggaatgcgatagatggcactgtgctggcaggggcaggaagaccaaggctgtgacattccagggagtgcgactgcagtgaagcgagtgaccacaaaacactgaacgtaagccctgaggctttgccacttgctggcaccaaggactctgcagtgttgagccaagaggatggactttggagccagactttctgggtctataatcattcagtgtctgtctcctcctctaaaatgcggacggtgggaaattctgacacacgcttcaacacagatgcaccttgaagacattatgctaagtgaaatgagcgagccaggcacgaaagggatgggactggggcctctctgtgcgtccccctgagagacaacggtctcttggccacccaccctgatcccacaggagccaggcgggcccagccctgagacaggccgcccgccgcccgcaattggactaaa

SEQ ID NO: 384624 - DNA, 554 bp, Homo sapiens
aaatgtgagctggtactgataacgcttggtactgtggcgtgcctgggcatttaacaaaggcaagaaggaaaaaaaggagaaaattggggattgagaaaattgaattaaagaagaaaagattgatcagattatttgaagagaaacctcatcacatcccaccgttgtttgcccccttcccgaccctgtgctctctcttccgattcagattcaaaagcattaactgggcacctacttaagctagactgtatgccaagctcctcgcatacaatttcctacacttttaaagttgcaggctttgtaactgctcttagcagaggcaggttctgctttagaaagtttgcataccatcatttttctcttggttcttaatcagcgaatcacactttcatcccgacattccctgcctgctcctcccttcagtgtgaccctgtactgcccaccaggtcttcctgctaaattctgtaggaaaagggagaccatatgaaaagcggctcctctggctcatggtgatagatgctctttgcctcgtttgggacccaggcctcggaataggc

SEQ ID NO: 384625 - DNA, 245 bp, Homo sapiens
gaattctgacatccttggaagtttctggaaccaattcccatgcataccgagggataaccttatatgtggatatatacatatatagatgtatatatttaggtctttaagtgtgtgtgtatatagttatatatgtatgtaaaaagtagagccaatgaatgagaatggtaaccaccaaattaaggatggagttttatcaggatagaggatgagaaataagataagggaaacgtacattaggggaattc

SEQ ID NO: 384626 - DNA, 321 bp, Homo sapiens
aaaaaaaacaaaaaacaaaaaagagtttgggtaggtggctcaacctctctaagcctgttttctcatctacagtgggggtgatagcatctaccacatgggcagtcatgaagataaagcacttagagaggttgagccacctacccaaactcttttttatttttattcgcatcagaccctatttgccggcttcatacctagaaggccagagccattcctggatgtcggcctagcaggccagagaacactctaggcaagggcatttcactggccccttcttcaccagaacccttcacccaatagtccatggccaaacaacgcact

SEQ ID NO: 384627 - DNA, 770 bp, Homo sapiens
caggtggtccacttcacattgctttccagacaactgcaatttgaggcaacttctatgacagtgatccctttgtttcacctggcatacattctaatcatactatttgcagtcacatcatgctattgttgctgcaagttctggatcaaaagtatcatctgtgaacctcaagagcaggggggactt[450 bp omitted]ctaaaagctgaacctctgagaataaatgccttatactaggaattggggaagagaaaagcagaaggaagttctaacaaagatcatgtttcaaagactttcagaaattatgaaggacacctctctgaaaagtactccag

SEQ ID NO: 384628 - DNA, 780 bp, Homo sapiens
acactgggtctaggatgggacccagggtcccgtatttctaacaagttcccgaagaaaggccaaggccaagctgctgctcatggtaccccacccaagtgtcgtccttgttttgttctgagtaccccctcacaatcaaaggagcacatcctggcctaaccataagttgtgttgcaaaaaaattgggaccttatgaaaaaaaggatgcagtggtgaatgaaaaatatgaaaaggatatgtttaaaaactgtactaaaccaaagactttgacaaagggattttgaagaaaagcaagaacgcagtggctcatgcctgtaatcctagcactttaggaggctgaggccagaagatcgctcgagagcaggagtttgagaccagcctgagaaacatagcaagaccccatcactacaaaagaaaaatttaaaagttagctgggtgtgatgatgcacaccttaagtctcagctactcaggaggctggtgggaggatcgcctgaccccaagtagtcatggcaccatcatgcagagagccgtgattgtgccactgcactccagcctggctgacagagtgagaccctgttcccaccactctctccccaaaaaaaagataaagaaaaaagaaggaagaggaaaggatgaaggtgaagcggaggaaaaggaaggattaaagacaaagatgatggcaatgacaggggagttggttctagcagttttccttgtctgtaaagcatttaattctcctgtgcacaactcgtttcttttgaataaataataagaaacctgaa

SEQ ID NO: 384629 - DNA, 348 bp, Homo sapiens
tttggtacagtaattaggtttggttgattcggttatagggggtatacacgcacatgcaaacacacacagggtgtgcgtgtgtgttataaggggcatatacacatgcacacatatacacatatgttatataggatgtgtgtatatgtgtgtatatatatagggtgtgtatgtatcctatatatgtacatatacatgtatatgttgtatatatacatgtatatgtacacatgtgtgcatatgtgtacatatatgtgtatatatgtatatattccacatctcctccaattttcctatacgtatatacacacatatatgttatatagggtgtacagatataggatatgtgtg

SEQ ID NO: 384630 - DNA, 340 bp, Homo sapiens
attttattgatgaagatttagaataataggtagagatgcagtatttgcatatgtgtttattgccacatcgatgcacatgaggattctttgtcacgtccagccatcatgtcttcttgttcaggtctaggtaccatctattagtgttttattttgttttgttttgtttttactgttaaatgcactggataatattaccttgccccctacccttcatgagaaagaggtagcaagaggtgatagtactcacaatgctatgggttattggaactgttcgtattgaaatcacgtagatcttcttgccctacggttccctagaaccctttatttaatgctggctact

SEQ ID NO: 384631 - DNA, 908 bp, Homo sapiens
ccgcgtcttattccttctaatctctcccctgccccttgtcttgcgcctgccttcctaacagccttcagttccccttctcccgtcagaccttcctgacctcccacctggttctctaggggcagggtggacaggaagcagctcagcccagcctgggagaggccaagggctgcctcctatcagagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccttttgatctcgtcattgtcgtcgtgtgtcttgtatgttggagta

SEQ ID NO: 384632 - DNA, 936 bp, Homo sapiens
ttgtgacgtctgtggagcggcggcggcggcggcggatcccgagcctggtccggcccggccttcccagtgcgctcggcccggcccgcgcaggcggcgagtcctccgagccccgggcccggacccctcgcgccggtccctgccccgcgcggcctcggagcgcgcgcggccccgccccgccccggcctcggcccgccgggcccgcagtgtgagagcgcctgctcgctgtgcccccgggttatgacgacccccaataaaggaaacaaggccttgaaggtgaagcgggagccgggtgagaatggcaccagcctgacggatgaggagctggtgaccatgtcggtgcgggagctgaaccagcacctgcggggcctgtccaaggaggagatcgtccagctgaagcagcgccggcgcacgctcaagaaccgcggctacgctgccagctgccgcgtgaagcgggtgacgcagaaggaggagctggagaagcagaaggcggagctgcagcaggaggtggagaagctggcctcagagaacgccagcatgaagctggagctcgacgcgctgcgctccaagtacgaggcgctgcagaccttcgcccggacggtggcccgcagccccgtggcgccagcccggggcccccttgccgccggcctggggcccctcgtcccaggcaaggtggccgccaccagcgtcatcacaatagtaaagtccaagacggatgcccgatcgtagggacgcgcgtctgcccaggcgggtctttgcggggccactaggcacatggcgaatttggctgccctgtccctctgtttccttctcttctctttcctccctctcttccccacccttctctcttccctgcaaagcacaacctgtaccccaggggcgccgggctgagcccttttgatctcgtcattgtcgtcgtgtgtcttgtatgttggagta

SEQ ID NO: 384633 - DNA, 343 bp, Homo sapiens
gtgatttgcaaccttgagtgattgtcttgaaataggaaccacagttgaaactgaagtagttaggtgttagtgagattttgatggctaggaacatcaggcttattttataactgaaagggaaatgagaacacgtcaccagttccatatgatcacaatgcatttggaataatcaccatggcaacccatgactgttgtattttgagagagaagaattggaaatataatgaccaagcataaagctgacccaatctaacatagatctttgtctttaacacatatctgtaatattcatgtaggcagtgtataaataacttatcagaattatcatttatgtgcaggttct

SEQ ID NO: 384634 - DNA, 1267 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 384635 - DNA, 1075 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttat

SEQ ID NO: 384636 - DNA, 733 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaagggtatggggaggggacgtggcctccccgaagaagaaccgatgcactggggctcctggcgtctgcggggtccataacgcctccctagggaggagagggaggagctaggagatgcagggagtgcagaaaccttggagaaagtgagagttttccagccaaagggaactttgtgtttccctggctgggactcttggggatctttttcaggttttctgcagtttttctgaattgagctttaaggcaactggatggattttgaactgattttaaaataaacgacaaattgcaaaaagaaa

SEQ ID NO: 384637 - DNA, 1777 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgaaaaaaaaacaaaaaaaacacaaaaacaacacaaaacaacacaaacaacaaacaaaacaaacaaaaaaaacaaacaaaacacaccccttcccccgcgagcgaaggcactcgagtaacgaacagagaagaatctttcctaaaaaaccgctcacttgtgaggagcgaaggcggcgagcgcgacccccaaaaatgaatcagagagacaacaagcaggagaaaaacaatggcgttctcccacagaaagaaacatcatcgggcagctacaatacaacaatcgtgtggtgtgggtgtatcatacccccacacacagacaagagacagacccacgccccgcgcggcgggaacacaccacggaggcagtcgtgtgagaacaaaaacacacgccgcgaggcgaccgtagcgtagtgagagagagagacacaaagaggcgggggagaaatcaacaaaagcgagggagggcaccacagccgagcggacatacgcgatctctaaacagaagatccccgccgg

SEQ ID NO: 384638 - DNA, 1319 bp, Homo sapiens
  misc_feature (1081)..(1081): n is a, c, g, or t
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaattgggtgttcaggagaacgaggaagtggaaaccaggtgggttgaggctgggggctcaaacaagcgtccccattcccattggggcccccaattttgtggttaacacttgtgttcccttggaagttgtgcntcccccaaaagggggggcaattttttacccaaaaatggttccctttaaatttattttcccaaaaaagagacaagcatacagcagccatatctacacaaagaaaaacacatatgtgtgtggggggaggagcatgtgggggcccctccgggaaaaaaaggttttttctgatgaaacacacattgcggtgtgtggggggagacagggggggcccccccaggtgtgtggcacatgggggcac

SEQ ID NO: 384639 - DNA, 1225 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 384640 - DNA, 1539 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 384641 - DNA, 990 bp, Homo sapiens
  misc_feature (873)..(874): n is a, c, g, or t
  misc_feature (877)..(877): n is a, c, g, or t
  misc_feature (882)..(882): n is a, c, g, or t
  misc_feature (884)..(884): n is a, c, g, or t
  misc_feature (886)..(886): n is a, c, g, or t
  misc_feature (892)..(892): n is a, c, g, or t
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccanngcnaaagngnanccgttnttggccttgcccttgtggtcccggactgtgtcgcactcgccggggggcgccccacgggccttgtcggggccggggctttttaaagatctcgttgcccg

SEQ ID NO: 384642 - DNA, 1470 bp, Homo sapiens
ctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgaaaaaaaaaaaagaaaagagaaaaaagaaaaaaaagcttggggagaggaccaatagcgacacccgacaaaaaacatttataaaagaacgcatggcgagagaaccgcggggcaccaagaagagaaaagagaaaaagtgtgaaaaaggaggatcccggagagaaaacggggaagaaaaaagggaggaagataccacaaaaaaaaa

SEQ ID NO: 384643 - DNA, 765 bp, Homo sapiens
gtttccctgtcctgtcgtcctgttaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccc

SEQ ID NO: 384644 - DNA, 342 bp, Homo sapiens
ccttggaaaaatataggactcaagttatcttgtctccttctttaagattgacaagaggctgggagcggtgactcaagcctgtaatcctagcactttgggagacccaggtggacggatcacgtcaggtcaggagttcaagactagcctggccaacatggtgaaatcctgtctctgctgaaaaatacaaaaattagtcaggtgtagtagtgcatgcctgtaatcccagctactcaggatgctgagccagagagaatcgcttgaacccaggaggcagaggttgcagtgagccaagatcgtgtaactgcactccagcctaagtggcagagtgagaaactccatctc

SEQ ID NO: 384645 - DNA, 353 bp, Homo sapiens
aatacaaaaaattagttgggtgtggtggcacacatctgtagtcccagctgctcaggaggctgagacaggagagtcgcttgaacctgggaggtggaggctggagtgagccaagatcacaccactgcactccagcctgggtgagacagagtgagactctgtctcaaaaaatccattcttgcaaagtggtgaaaacaaagtttttacttatttattgttccttggagtctttggacacttgtttttttgaaatgtacaatttagtggttttcaatacattcacagggtttgtgaccatccccactatctgattccagaaaggggtgatctaattctgaaagtcactatgactttaa

SEQ ID NO: 384646 - DNA, 354 bp, Homo sapiens
ccatttacaaaaactacaatggtaggtgttgagggatataagtggggtgcctgcagtgattgctacacatggattccgatgacattgtgtaattaatgaagaactatgtgatctaattctacaaacttaaagtccaaaataaaaatagtctagagaatagcattcagatatttgtgacaacatttttgatgacccttaaagatgggattagggaccagaactgtatacatggtcagctttcttttagttacttggaaaagatacgaatatttatttcaaaatgctgctgcttttagttaatttaatatgaataaatagccagtttgaaatttccatttttctgaatttttatag

SEQ ID NO: 384647 - DNA, 239 bp, Homo sapiens
caaagatgtcacactgaagcagggagggagtggagataaaattggctgatctcccttccccaccccagtctccccctggtgtctcccactggccaaatccaatccaatcagaagccagtgggtaaatgaatccaggtgatagagtccacagaggttagcccctcatggcacagaacaggacaaagaagaggaggaatggatctggagtggtagagactggactggagcagtggagaaaa

SEQ ID NO: 384648 - DNA, 181 bp, Homo sapiens
tttattgggagccggggtggaggtcgggccgaacagaagcgtcgggcagcgggcgatggaccagaagatcatcctggagctggaccggaaggtggctgaccagcagagcacactggagaaggcgggggtggctggcttctacgtgacccagagaaataaagatgcctcagtgtggcccaaa

SEQ ID NO: 384649 - DNA, 1093 bp, Homo sapiens
gggacaatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaactgcagaagaggctcccaggcccaagctctgtgtgacccagagaaataaagatgcctcagtgtggcccaaa

SEQ ID NO: 384650 - DNA, 1031 bp, Homo sapiens
gggacaatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggactgccttctgtccttcatccgcctgctgctgaattacaggaagtcctcccgccatctggctgccttcatcaacaagtttgtgcagttcatccataagtacattacctacaatgcatcagcagctcgcccctgagtt

SEQ ID NO: 384651 - DNA, 898 bp, Homo sapiens
gggacaatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgccctgcagaagaggctcccaggcccaagctctgtgtgacccagagaaataaagatgcctcagtgtggcccaaa

SEQ ID NO: 384652 - DNA, 1036 bp, Homo sapiens
ggatccccgcacccaggcgcacttctaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 384653 - DNA, 1159 bp, Homo sapiens
gggacaatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 384654 - DNA, 1058 bp, Homo sapiens
gggacaatcgtaaaaggggcgggacgcgccgcgctcgggatgtcgtgaagctgggggagctcgtcgccgccgccggcggctagcgggcgtccgcgccatggagcgctacgcggccgccttggaggaggtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 384655 - DNA, 487 bp, Homo sapiens
agccaggctacctgcaggggagcctcaggggccctggagttccctggggactggccaccagagaagagctgcaacatcagggctcttcccaggaacagagtgttgggtttcaccttttcttttggccagggacccctccctcctggggagctgtagccatttggcacttactggtcactggcgccagctgtggggtgctgcatgttctgtttcatggtggtttatgtcccatgatcgcttcctctgtacattcccttcagaccagacagtttgcacacatctgtgtttgtgcacagtttagcaaggaccgtggagctttacttgatggctgagggtgagcccctcagagccacacaggcttatggcaccccaagctcatcccaaacttgggcctcccaggtctgcccacccttctcctgcagaagaggctcccaggcccaagctctgtgtgacccagagaaataaagatgcctcagtgtggcccaaa

SEQ ID NO: 384656 - DNA, 1066 bp, Homo sapiens
cgacccacgcgtcgcccacgcgtcggacccacgcgtggcggacggtgcccggcagcaggagcgacactaccagttgctgtcggcgctacagagcctggtgaaggagttgcccagctctttccagcagcgcctgtcctacaccacgctcagcgacctggccctggcgcttctcgacggcaccgtgttcgaaatcgtgcaggggctactggagatccagcacctcaccgaaaagagcctgtacaaccagcgcctgcgcctacagaacgagcaccgagtgctcaggcaggcgctgcggcagaagcaccaggaagcccagcaggcctgccggccccacaacctgcctgtggttcaggcggctcagcagcgagaactagaggccgtggaacaccggatccgtgaggagcagcgggcgatggaccagaagatcatcctggagctggaccggaaggtggctgaccagcagagcacactggagaaggcgggggtggctggcttctacgtgaccaccaacccacaggagctgatgctgcagatgaacctgctggaactcatccgaaagctgcagcagaggggctgccgggcagggaatgcagccctgggactgggaggtccctggcagtcgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcaggaccaggcagagagtgaggctgggggttctcacaccttactccaccgggcacatcccaacctgcactggggcccacccgagcgcttgttctggtctcagccgctcccttggcagctgcagcccccatgcagaagaggctcccaggcccaagctctgtgtgacccagagaaataaagatgcctcagtgtggcccaaa

SEQ ID NO: 384657 - DNA, 7157 bp, Homo sapiens
  misc_feature (1485)..(1485): n is a, c, g, or t
  misc_feature (2795)..(2795): n is a, c, g, or t
  misc_feature (2805)..(2805): n is a, c, g, or t
  misc_feature (5171)..(5171): n is a, c, g, or t
atgaattattcatcattccttagaatttgggtctctttcatcttcgcacttgtacagcaccaagctcagcccagggagctcatgtatccattttggcagaatgacaccaaaacccctaaagtagatgatggaagctcatctgagattaagttggccatcccagttttcttctttggcgttccttaccgcactgtctatgtcaataacaacggagttgtttccttcaatgtgctagtgagccagttcacgccagaatcctttcccctgacagatgggagagccttcgtcgccccattttgggcagatgtgcacaatggaattcgaggcgagatctattacagagagaccatggagcctgccatcttgaaaagagccaccaaggacatcaggaagtacttcaaagacatggcaaccttctctgccacttgggttttcattgtgacatgggaggaagtcacgttttatggaggcagcagcaccacacctgtgaacaccttccaggccgtcctagtgtccgatggctcctatacattcaccctcttcaattattacgaaatcaactggaccacggggacggcgagtggcggcgaccccctgacaggtcttggtggagtgatggcacaggcaggatttaatggtggaaacctcaccaatttcttcagcctcccggggtcaagaacccccgagatcgtgaatatccaggagaccacaaacgtcaatgttccaggccgctgggcatttaaagttgatggaaaggaaattgacccagccaatggctgcacctcaaggggacaattccttcggcgaggggaggtgttttgggatgacttgaactgcaccgtcaagtgccgctgtctggatttcaacaatgagatctactgccaggaggcttcctgtagcccctacgaggtgtgcgaacccaaaggcaaattcttctactgcagcgctgtggagaccagcacatgcgtggtgtttggggagccacactaccacacttttgacggcttcctcttccacttccaaggctcctgtgcctacttgctggcccgacagtgtttgcagacttccagcctccctttcttcagtgtggaggccaagaatgaacaccgcggaggttcagccgtctcctgggtgaaggagctctcagtggaggtgaatggctacaagattctcatccccaaaggaagctatggaagagtcaaggttaatgacctagtgacttctttgcctgtcaccttagacttggggacagtgaaaatctaccagagtggcatatctactgccgtggaaacagattttgggctcttagtgacttttgatggccagcactacgcctccatttccgtcccaggctcctatataaactccacctgtggactctgtggaaactataataaaaacccactggatgacttcctccgcccggatggcaggccggccatgtctgtcctggatctgggagagagctggcgtgtgtaccacgcngactggaagtgcgactccggctgcgtcgacaactgcacccagtgcgacgctgccactgaagccctctactttggctctgactactgcggcttcctcaacaagacagacggccctctgtgggagtgtggcactgtcgtggaccccactgcttttgtgcacagctgcgtgtatgacctgtgcagtgtgagggacaatggcacgctcctctgccaagccatccaggcctatgctcttgtgtgccaagcccttggcattccaattggagactggcgaacccagactgggtgtgtgtccacagtgcagtgcccgagcttcagccactactccgtgtgcacaagcagctgccccgacacatgctccgacctgacggcctcgcggaactgcgccacgccgtgcacagagggctgcgagtgcaaccagggcttcgtcctcagcaccagccagtgcgtccctctgcacaagtgcggctgcgacttcgacggccactactacaccatgggggagttcttctgggccacggccaactgcactgtgcaatgcctgtgcgaggagggcggggacgtctactgcttcaacaagacctgcggcagcggggaggtgtgcgccgtggaggacggctaccagggctgcttccccaagcgggagaccgtgtgcctgctcagccagaaccaggtgctgcacacctttgacggcgcctcctacgccttcccctccgagttctcctacaccctcctgaagacctgccctgagcgcccagagtacttggaaatcgacatcaacaagaagaagcccgatgcaggacctgcttggctgcggggacttcggatcctggtggccgaccaggaggtcaagataggaggcatcggggcttcggaagtcaagttgaatggtcaggaagtggaattgccttttttccatccttcggggaagctggaaatttatcgaaacaaaaacagtacgacagtggagtccaagggcgtggtgactgtccagtactcagacataggtctattgtacatccggctgtccaccacatacttcaattgcacagggggcttgtgcggcttctacaatgccaacgccagtgacgagttctgtctccccaacggcaagtgcacggacaacctggcagtgttcctggaaagctggacaactttcgaggagatctgcaatggagagtgtggggacctgctgaaggcctgcaacaatgactcggagctgctcaagttttatcgaagccgctccaggtgcggcatcatcaacgacccctccaacagctccttcctggagtgccatggggtggtgaacgncactgcctantaccgcacctgccttttccgcctgtgccagagtgggggcaatgagtcagagctctgtgactctgtggcccggtatgcaagcgcctgcaagaatgcggacgtggaggtggggccctggcggacctatgacttctgcccactggagtgcccagagaacagccactttgaggagtgcatcacatgtacagagacctgtgagacccttaccctgggccccatctgcgtggatagctgctctgagggatgtcagtgtgatgagggctatgctctactgggcagccagtgtgtcacgcggagtgagtgtggctgcaactttgaggggcaccaacttgccaccaatgagaccttctgggtggacctggactgccagatcttctgctattgcagtggcacagacaacagggtccactgcgagaccattccctgcaaggatgatgagtactgcatggaggaaggtggcctgtactactgccaagcccgcaccgacgcctcctgcatcgtctcaggctacggccactacctcacctttgatggcttcccctttgacttccagaccagctgcccactcatcctgtgcaccacaggaagcaggccaagctcagactctttccccaagtttgttgtcacagccaagaatgaggaccgggacccgtcactggccttgtgggttaagcaggtggacgtgaccgtgtttggctacagcatcgtgatccaccgagcttacaagcacactgtgctggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcactgtcacctgccctccaaacagccattacgagagctgcgtgagtgtctgccagccccgctgcgccgccatccgcctgaagagtgactgcagccactactgcgtggagggctgtcactgcgacgctggctacgtcctcaacggcaagagctgcatcctgccccacagctgcggctgctactccgatggcaaatattacgagcccaagcagctattttggaacagcgactgcacgcggcgctgccgctgtttccgtcgcaacgtgattcagtgcgacccgcgccaatgcaagtcagacgaggagtgtgcgctgcgcaacggggtgcgcggctgcttcagcaccaagacctcctactgcctggcggccggcggcggcgtcttccgcaccttcgacggcgccttcctgcgcttcccagccaactgcgccttcgtgctgtccaccatctgccagaaactgcccgacatctccttccagcttatcatcaacttcgacaagtggtcggcccccaacctcaccatcatttcgcccgtctacttctacattaacgaagagcagattctcatcaacgaccggaacacggtcaaggtgaatggcacacaagtgaatgttccatttataactggtttggcaaccaaaatctacagcagtgaggggtttctggtgattgacaccagcccagacatccagatatactacaatggtttcaacgtcattaaaatcagcatcagcgagaggctgcagaacaaagtgtgcggtctctgtggcaacttcaacggggacctaacagatgattatgtgaccttgcgagggaagccggtggtaagcagcgtggtgctggcccagagctggaaaaccaatggcatgcagaagagacctcttgcccccagctgcaacgagctgcagttctcacagtatgcagccatgtgtgacaatgtgcacatccagaagatgcagggtgatggctactgcctgaagctcaccgacatgaagggcttcttccagccctgctatgggcttctcgatcccctcccattctacgagtcctgctacctggacggctgctacanccacaagaagttccagctgtgcggctccctggccgcctacggggaggcctgccgctccttcgggatccttagcaccgagtggattgagaaggagaattgctcaggagtggttgaagatccctgtgtgggggcggactgtcccaaccgaacttgcgagctgggcaatggcagggagctgtgtggctgcatcgagccacccccctatggaaataactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcagtccaatggcacgcatatcatgtataaaaacacactctggatcgaaagcgccaacaacactggcaacatcatcaccagggaccgcacgatcaatgtggaattttcatgtgcttatgagctggatatcaagatctccttggattctgttgtgaagcctatgctaagtgtaattaacctgacagttccaacccaagaaggcagcttcatcaccaagatggctctctacaaaaacgcctcctacaaacatccttaccgccagggtgaagtagtgttgacgactcgagatgtgctgtatgtaggggtttttgtggttggagctgacgccacacatttaatcctaacactcaacaaatgctatgccacacccacccgagatagcaatgataagctccgatatttcatcattgaaggagggtgtcagaacctcaaagataacaccattggcatcgaggagaatgcagtctccctgacctgtcgctttcacgtcaccgtctttaaattcataggggattacgacgaagttcaccttcactgtgcagtgtcactctgcgactcagaaaagtactcctgtaaaatcacttgcccacacaattccaggattgccacagattacacaaaagagcccaaagaacagatcatttcagtgggacctattaggagaaaaaggctggactggtgtgaggacaatggagggtgtgagcagatttgcacgagccgggtggatgggcctctctgcagctgtgtaacaggaaccctgcaggaggacggcaagagctgcagagcctctaattcttcaatggaacttcaagtctggacgcttcttctcatcatgatccagatttcattatggcattttgtctataaatcaggcacgacctcataattaactcaaggttgctatataaagtactgtaatttacttacttcaacaccctgtaggataaaaagtgtgtgcccttaagtcaaaacctatttgaaagtgtccagcatctcaaaatgatgccacctgcctccaatggtccaaggtccagaaaccagcgaccatccaagctcctctttcagagtatgaaacggggcttctacaagccagttatggaaagtatctctcttgtgtaaaattcccaaacagttgtcactagagactttggttcacatgaaaaaccagtaaaggaaaaaaattctggttagagaaatctgactggaaatctgaccagagaaatctgtcaagccagtgctatttctggatcacagttttttacagagagagggcctgttggaacgattttgaagtgatgactggaaggtttgactccctctaaggaatcttgctggtgtttggaagtgtccgatctacgttatgcacgtgttctgtctatgaggcgcttctccacccactgtgtccttcaaccttgccatggcagctttggccactggggatattgttgacctggggaaccccacccactctcctaccccctcgaacccaatcccttctctttttacaaatcaaccaaatactttttaatgtgttttatccttaaataaactttgtgttcaagtattctcattact

SEQ ID NO: 384658 - DNA, 583 bp, Homo sapiens
ctcctgcagcaagaccgactccactgatttgcctttcgtaataactgttcccacagactcacatgacattatcgatgcagaggtgacctgcaaagcagcccaaatggaagtgtccatatctaagtgcaagctcttccagctcggttttgagagggagggcgtgaggatcaatgacagacagtgcaccggcatcgagggggaagattttatctcctttcagatcaacaacaccaaagggaattgtggaaacattgtgcaggtgagaaaagcagcaggaaagagcacctggcagaggcagcgacagcttcgagtgtttgcacatttattgtcctgaaaaccaacttcagggtgatctgcttagaaatatgctccttagaaaacagcaataggcatgtgcaacatgaaagacagcaagagcagtcatcatttgatgctaagtgattgacggagttgaaagagtgatgtgttttttccttggtttgggatgcctactgtggttctttctcctgtatatggacaggattgtgtcttcttttctgcttctattgctctttgaggcaaatacatataggcttagctattt

SEQ ID NO: 384659 - DNA, 832 bp, Homo sapiens
caggtactgggggttaaggcctcaacatttcttttggggggacacagtgtaacccacaatagggggtcattggagacaatgagcatcaaggagaaatggattaaagaggtcaacagtgaacggctctatctgcccctgaagctggggcaagggaagataaatatcttttcctttggcttccacgtggtggtggaaactgattttggcctgaaggttgtatatgactggaagaccttcctgtccatcacagtccctcggagcatgcagaacagcacctatggtctgtgtggccgctacaacggcaaccctgatgatgacctggagatgcccatgggtctgcttgcatcgagtgtcaatgagtttgggcagagctgggtgaagagggacaccttctgccaggtgggctgtggggaccgctgtccgtcctgtgccaaggtggaaggtttctccaaagtgcagcagctgtgcagcctgatccccaaccagaacgctgccttctccaagtgtcacagcaaagttaaccccaccttcttctataagaactgcctgtttgactcttgcatcgatgggggcgcggtgcagaccgcctgcagctggctgcagaactacgccagcacctgccagactcaggggattacggtgactggctggaggaattacacgtcctgcagtgagtccttctcgttgtccctccttgtagcttctcctctttcttgattgctctgggaaggccagtcttccaactccctagaagtcagagcaaattgagtagcaatttaaggatatgcactttggaactgagtttgttatctgaatgaagcatgacatgtaa

SEQ ID NO: 384660 - DNA, 954 bp, Homo sapiens
tagtcagacaaaatgtgaagggtccccaaaaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgaggactctaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggcccagtaactcaattagcaacccccagccccagctccctcccctcccctgtgagggacatcgaggagaggagaagaatcggtctgcctcccgaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatgatccacctctcaccttaaaaaaattaaaattaagaaaacaaaat

SEQ ID NO: 384661 - DNA, 440 bp, Homo sapiens
gaattttccaaggaattaaatgataacagtggctaaggcatagtttctaaactttcagtaagatcctggcattcacagaaaaaaatgatgaatggggtctggacatacagcctgagatctcaaaatgacaatgaaattcacaactttttctcagagacattcatgtttcctgcatatgctacaactgcagtttgaaagaggcagcaatgggagcaaccctttacaagaaacaaattgtgatatattcatgtgttggacggcagtaaataagatgaaacctgaggagtcagatccaccttcccccattcatagaggcttttcagcctcattttgaggtacagttacatatcttttgccttttgcccccgtgcatagctatctacagccaatcacagatcacagagtcactggactatagagctggaaggaagctcagagac

SEQ ID NO: 384662 - DNA, 2207 bp, Homo sapiens
acgtagtgtaggtactggcctttctaatagtcttggtatttagtgccagactcccatcaatcttttgaatgtcttttctttttctttttgcacttttctagcttttcaagtgatgactatatactgcttttcttgactgtatatattgttactgaattgtgaatatctgcagaaatgtttactagagaacctgtgactgttgaataacatgtgcccgaacatacacacacacatatgtacacacacacctcagagtactctttcttacagcggactttgctgctgctttctgcatgtgtgggacactggtatctcccgtctcagacaaatggctgatgttctctatgatattggtgttaatatcaaagaattgaatgaatacaacagaattgaggttgaaaaatatttgattgccacattcctttaagcatctttgatgaatactctgcaaagtagcctttaaaaaaatgtaaattttttaaaaagtccacagaggagaatttgctggttagcacaaaacatactgcaaaattgcttctttctggttattataactgaagaatatagaagattgacacacattttatacaccctcaggcagtgttttggaataatattgtaccttttcaaattgttatcaattaactgtttttctccatttcataattctcaagatttttctaaatacagcctttaaatttgactcaaatggaaattgtgcactttcctgtttatacccttccccacgttattgtaaaagagtttaacagcagcctgatatgtaagtttcagcaaaacttatacctgtatatgtttttatttgactcaaaaattagatattttaccatatagtcataagaatttgctcactttgatgccagaagtacttaagaagttacacggcactaattttatgagttgtatgcctaatttcaatttctaacctatttgacagtttcttttaggtcagcctttgttggtcttccatgtaaatacaagttggtacaaatcaatagaaaccattttacctacataggcaaagtaaatgtgtgacttagagactgccagatttatggtgcatctacctttttatccatttgagcttgcttttttatgtttgtgtattggttgctcctgacactatacatttcaaaattttttataacttgaaaaacacttctgtgctaccactcagttctgatcaaatccttacattttgcaacactcatttctgaattttcagtaaagaaatacacattacaaattaaaggttaaaggcccctttacatgcccttccccagtctcctcttcctcccccggaagtgtccattctgctgaattcaggttcatcattgccagacaaatgtagtaagctagtgtttcacatttccaaaatcagccttctggcagacttggaagtactcttgagaaaagaagactcgtgaccaaattctcccacagatttgtaataatgtacatattgaaaggactgaaggctctcagactgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaacaaagatgactaatagtaatcactccaagttgatgttgactgttgggttgtggtgaaatcattttgcattaaaggaaggtaaaatactaataaattgcatattccttgaccagagcacagattacttatgcttcttaattttttaaaatcttaaatcctctgtccaactggagtatctggctatgggccatgggtactcatataccctttgtcttaaactgatctgttacattttatgttcttgtggctagaagtagcctgagtttgctgttaatgtttaacacattttcttgagtaacagttctgttaatattgtacaagatggtacttgaattctttgtttgccttttttcttcctgtattagaaaatcttggtgctttttataagttttgtataaaagaattttttttaagatttgttcataaaatggtctgatccaggaaaaataaaatgggaacatggacaccatttctgaccttcaaataaaacttattatgt

SEQ ID NO: 384663 - DNA, 632 bp, Homo sapiens
cctgcctcagccttctgagtagctgggattataggcacacaccaccacacctggcttatttttatatttttagtagaaacgggatttcaccatattggctaggctggtcttgaactcctgacctcaggtgatccaccctgcctcggcctcccaaagtgctgggattacaggtgtgagccaccgcacctggcctgaggactctgaatcttgatacaggactgtgcagattgtatttgtgaataacttcttttctgacatctgagggaggacaggaggggtaggaggaccatgtagtctcatgcgttgaaacagtggacgcacagatcctgcaacattgtcaaaatccatgtttttactaaacatacattaatatttctttctcttacttctacaagttaaattaatatcactttgtggaatttttggttttgggctccagcagagatctcgtccatatttagtattagccagcgtcttagcaatgttgacaaaaggtgagaggaaaaattgctgaacatgatgctgcaaaagcctctctctatgtgtgatgaactgaaaaaggcaacctcgattatcttttttgagcgtttcagtttgagctgatgcataaccagggaatgtaaaagatccgt

SEQ ID NO: 384664 - DNA, 4329 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384665 - DNA, 4195 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgc

SEQ ID NO: 384666 - DNA, 965 bp, Homo sapiens
gttctcggccggctgaggcagatccttgttcttgtttgagatcgggctgcggcccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaagcgcggttgactgccctgctgtacaccgcagaaggtgccgccttacagtgctcccgtttctgctcgaggggtggggccgataggcccgagagtgcccgtgcagggcttggcccctcccggtac

SEQ ID NO: 384667 - DNA, 632 bp, Homo sapiens
  misc_feature (1)..(1): n is a, c, g, or t
nccaaatacgctagtacaggcctggagattactcgaccgagggctgacctcctacttgtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccattgctgattgcagaatagcggacaccactctaccagtgaagccgggacctttgggg

SEQ ID NO: 384668 - DNA, 4343 bp, Homo sapiens
caatccgcgaatgctaggtagctgcgtgcttatcggcaccgaggctgacctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384669 - DNA, 4319 bp, Homo sapiens
gggctctggcgccgggggggacgggatccagcaggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384670 - DNA, 3146 bp, Homo sapiens
gccctgaatcctgttgctgatcccatttgggcatccctgccccaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384671 - DNA, 4349 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcagccaggcctctcctgccccaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384672 - DNA, 2331 bp, Homo sapiens
cttaaggacttgctgatcgcttagcagggaggggcgtgtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384673 - DNA, 2228 bp, Homo sapiens
gttctcggccggctgaggcagatccttgttcttgtttgagatcgggctgcggcccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384674 - DNA, 2013 bp, Homo sapiens
tcctgggagacaggagtgatggcagggaggctgctgaggcggcaggctgggctgggattttagcaggctggaggagcactgttgggggatgctgagttgagtcaatccatgtctggagttggaggtgagaccctcctggtggcggaagagaggtctcaggctaagaagggacccacggcagggtctctggccagtgtcgaggctgggcccagttgagggtagagagaacagatttctagttgcattgccattccagctgtgacttagcaagtgcaggtgaagaggtagacaagattgggatttcaccagaggcggccagtggggcaggagatgaagccccaaggcagagtccaggctgggcctgtgggtccttgtccttttgaggggacacatgatagccatcactgcccagtgatgaatccggactctgctgatttctagtgttgagaccttggcctctgcacctcagtttgctcattcatagagtgctcgtccttacctccagggttatgggaggatgaggtgcagtctccagtgtggtgggcttggcctggactcctcctgctgtcagcttggggtctgggcactgtcagagttgttcccaagctgatgcctttgcctggcccaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384675 - DNA, 1129 bp, Homo sapiens
cggaatcccgggtctacccacgcgtccggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384676 - DNA, 2714 bp, Homo sapiens
  misc_feature (2680)..(2680): n is a, c, g, or t
  misc_feature (2705)..(2705): n is a, c, g, or t
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgctggaaatgctnacggggtcctctagagtcgaccggngcacccaag

SEQ ID NO: 384677 - DNA, 4029 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384678 - DNA, 4405 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtatggccgccgccagcttgcagactggagctggagaggtgggggtcatggccctgagtcctcctctggtccttaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384679 - DNA, 4367 bp, Homo sapiens
  misc_feature (71)..(71): n is a, c, g, or t
  misc_feature (79)..(79): n is a, c, g, or t
  misc_feature (81)..(82): n is a, c, g, or t
cgcaaaaagaaaacaagaaaaaaaatacgttcagaacgacgctcagtgattatacaggcacgagggctgancctcctgncnngtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384680 - DNA, 3978 bp, Homo sapiens
  misc_feature (28)..(28): n is a, c, g, or t
  misc_feature (48)..(48): n is a, c, g, or t
  misc_feature (55)..(55): n is a, c, g, or t
aggcctaggtacgaggcctgggtggtcntgcacactcctcatcgtcantcgctantgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384681 - DNA, 3976 bp, Homo sapiens
tacgcgaggcgtggtgtggcgcccgccacacgcctcatcggggactcgctactgttgcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384682 - DNA, 2433 bp, Homo sapiens
gctgtcctctgagagactcaggtatacctgggccagccttctccggcgagactgagcagccagcggagctcggaagggaagtccagctagactcactgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384683 - DNA, 2213 bp, Homo sapiens
tgctcggcgactctacaggatcctctccccgtactgccacaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggatgatgccaactttaagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggcagcctcgggggtgtggagaaggagctgacgctgcgcagccaagccctggagctcaacaagcggaaggctgtagaagccgcccagctggccgaggacctgaaggtgcagctggagcacgtgcagactcggctgcgggagatccagccctgcctggcagagagccgggctgctcgtgagaaagagagcttcaacctcaagagggctcaggaggacatctcacggctgcggcgcaagctggaaaagcagaggaaggtggaggtctacgcagatgccgacgaaatcctccaggaggagatcaaggagtacaaggcgcggttgacctgcccctgctgtaacacccgcaagaaggatgcagtccttaccaagtgcttccacgttttctgcttcgagtgcgtgcggggccgctatgaggcccgccagaggaagtgccccaagtgcaacgcggcctttggtgcccacgacttccatcgtatctacatcagctgaacctgaaactcaggggactctggaacaccatggaccctgggggctgtgcccccatctcctccccaccccaggtctagtggccccaccctccattccggaccccatgggcccagcccctgcccatctagttggtttggggaccctggtgcatgctagtgggcatgggatcagccaagcttcgttccatcttttcctaaaggtcagagctgcagcctagggggcactgccctacagaaaaggtctgcctgagaggcctgaggagcccagagcacttgactgagcttcccggaaactggccctaacctgtctgtctccgtggatgcatcctaaccctaaggaaaattccccaggctgtgatctaccctagagaaggctcgctccctgcctactggctcacaaatgaggaccagtgagccatgtccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384684 - DNA, 3111 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtggccctgcggagccttcctgaggaggtagtgcgggagacgggggagtaccgcatgctgcaggcccaattctcactgctctacaacgagtctctgcaagtgaagacccagctagacgaggctcggggcctgctgctggccacaaagaactcccacctgcgacacatcgagcacatggagagcgacgagctggggctgcagaagaagctacgcacagaggtcattcagctggaggacacgctggcccaggtacgcaaggagtatgagatgctgcgcatcgagtttgagcagaatctggcggccaacgagcaggcggggcccatcaaccgtgagatgcgccacctgattagtagtcttcaaaaccacaaccaccagctaaaaggggacgcccagcgatacaagcggaagcttcgagaagtacaagctgagattggcaagctccgggcccaggccagtggctctgcccactccacccccaacctgggccacccagaggattctggcgtcagtgccccagccccagggaaagaggagggtgggccaggccctgtcagtacccccgacaacagaaaggagatggctccagtgcctggcaccaccactactaccacttcagtgaagaaggaggagctggtcccctctgaagaggacttccagggtataacccctggggcccagggcccttcctcccggggccgagaacctgaggccaggcccaagcgggagcttcgggaacgggaaggtcccagcctaggacctccacctgtagcctccgctctctcaagggctgatcgggagaaggccaaggtggaagaaaccaagcggaaggaatcagaactcctcaagggtctccgagcagagctcaagaaggcccaggagagccagaaggagatgaaactgctgctggatatgtacaagtcagcgcccaaggagcagcgggataaggtgcagctcatggcagcggaacgcaaggctaaggccgaggttgatgagctgcggagccgcatccgggaattggaggagagggatcgaagggagagcaagaagatcgcggatgaggatgccctgcggcgcattcggcaggcagaggagcagatagaacacctgcagcgcaagctgggtgccaccaagcaggaggaggaggctctgctctcagagatggatgtgacaggtcaggcttttgaggacatgcaggaacagaacgggcggctgctacagcagttgcgggaaaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaaatgtagtcccccgattttagctgcagcagctgagcagcactttgctggcttggtgtgagcctgggagggctcagacttaacggccggcagggatcccggactgg

SEQ ID NO: 384685 - DNA, 1260 bp, Homo sapiens
agcgggaaatccaagatggcggcgctaggctgaccctcctgctggtgacggaagtaccgcctcctcccgtctgacgcccctcaggggaccctgcatcgctccagccgccgcggccatgtctgggccaggcaacaaacgcgccgccggcgacgggggctcagggcccccggaaaagaagctgagtcgtgaggagaagaccaccacgactcttatcgagcccattcgtcttggaggcatctcttccacggaggagatggacctgaaggtactacagttcaagaacaagaaactggcagagcggctggaacaacggcaggcttgtgaagatgaactccgagaacgaattgagaagttggagaagcggcaggccacagatgatgccacactcctcatcgtcaatcgctactgggcccagctggatgaaactgtggaagcccttctccgatgccatgagagccagggggagctgtcttcagcgcctgaggcacctgggacccaggaggggccaacatgtgatgggactcctctcccagagccggggacatcagagctgagagaccccttgctgatgcagctgcggccccctctcagtgagccggccttggcttttgtggtggcactgggtgccagcagcagtgaggaggtggagctggagctgcaaggccgaatggagttctccaaggcagctgtgtctcgtgtggtagaggcctcagaccgcctacagcgccgggtggaggaactctgtcagcgagtgtacagccgaggggacagtgagcccctcagtgaggcggctcaggcacacacccgagagctgggccgtgagaaccggcgactgcaggacttggccactcagctgcaggagaaacaccaccgcatctcattggagtactccgagctccaggataaagtgacatcggcagagaccaaggtgctggagatggagacaacagtggaggacttgcagtgggacatcgagaagctgcggaagcgagagcaaaagctcaataagcacctggcagaggccttagagcagcttaactctggctactatgtatctgggagctcctcaggcttccaggggggccagatcacactcagcatgcagaagtttgagatgctgaatgcagagttagaggaaaaccaggaactggccaacagccgtatggcagagctggagaaactgcaggccgaacttcagggggctgtgcggaccaatgagcgcctcaaggtgggctgctgtaggggctgagaggtcctggg

SEQ ID NO: 384686 - DNA, 412 bp, Homo sapiens
gggccttgcctcgtggccccccgccctggggcccagcacctgtaggtcctggagcaccgattcagggaaagcgcaaacaaatgaatgctggccatcaggtggtgaggatgctcctgtcagcctcagggcacctggatcccgaatggtcaggaaggcagattgggggtggggaagggtgtcaggatgtgtcaaaaaatgaggttttctaactcaaccatggcttagatagagagaaagcaactctgagggaacacccctttgtgtgggggctctgggcttctgaagcctgaaaggtaaaatgaccctgagaatgatctcgtgggctcccccatcccacacaccacctgctgctagaagtttgatctgaccacacccacccccgtccttcctgggccaggcccccttatagagc

SEQ ID NO: 384687 - DNA, 262 bp, Homo sapiens
  misc_feature (222)..(222): n is a, c, g, or t
  misc_feature (225)..(225): n is a, c, g, or t
  misc_feature (231)..(231): n is a, c, g, or t
  misc_feature (233)..(233): n is a, c, g, or t
gtgaagtccagggcacagagaaacatctttgcaggcacctgtgaacacattgtgcccacaggaaattcaagctcttcttctattttcaaactaaggagtcactctcataaacatcgcaggggtcggggaggtggatgggaattgcttgactttcctacaatgcttggagattcttagagctggaacgtttccattttgatgttcccgccactctccctcttntantttacncntgccaagcacgtcagcccatctacgggtc

SEQ ID NO: 384688 - DNA, 567 bp, Homo sapiens
cttaaacagtatagggtttcttcctccagccagagaaatggcagactccctacattagcattcaggaaccccagtgacctggccccattgtgccttcctccttcgttcatttcccatggcatccttttcttagatgtcagtctcgctcctcatcctaaagttgcccaattgcactggcttcagaactacaattcacaggcaaccctgtggaggcatttttcccatctcttccccctcatcctccctgtcctcttcccctccttgttgcctttgtagccctcctcctcctcttttaacacagtccagataggtcttcatgtaggggaaaaaaaagaaaaaaaaaagacctataaacataacactttttttagtagtggggaccccatctctacaaaatataaaaaaattaaaaaattatctgggtgtggtggtatgtgcctgtaggcatagctactctggaggctgaggcaggaggatcacctgagcctagggatttgaggttacagttagctatgactgcaccactgtactccagcctgggtgacagtgcaagaccctgtctcttta

SEQ ID NO: 384689 - DNA, 484 bp, Homo sapiens
ttaaggttactaatatatataaagtacttttgattgtaagcaatagcagccatgcatgcctactttaagccaaacagggaatctattggaaggaaactggaagaaatcacagatttaaaggagatggaaacagcccaagacaaagtcaaagataactctgggacagtcagcagccttgggctccatataccttcaccctaaagttttaatataacttaactcccaccagtcctaggagagagaaatgcccacccaccttccaggtcagccagacttagtaaggatcaaataaagcaaacagttttggagaccctcccctgggtatcatggaatcattctcagagcaaaagcaattttgaggaaggccatcaccataaaaattgtcaactgctagcacagttataagcaaagtatttgttttctaaataatttgcctatacgttgtcttgcatgattagtataagagcaaatcagagcataagaa

SEQ ID NO: 384690 - DNA, 571 bp, Homo sapiens
gtagttagtcagtaggacccagttagttaacttttttctaacaaagtaaaacatttattagccccataaaaaaaaattcttgtaatacctccttcatttagaggtttactttccttcattctgtaaaaagaaagaaggaaacttttattcttcttttccttggtcttttgataagtctttgatatttgcataatctttgtgagttgaaactttgttttaaataccaacagtgtatgtggaatcatattctgtgtagagattatttttgtattctgcctgctgccctttctacacatttttgtcttacggtgtttttcatgaatgtagatgaaagcttcctactctgagcttgactttcataacttctctttcatagatggtcaccagataaaatgaaggcttctcggttaccttttcattttaaataaacaacaaaaagcattttagtataattgtcaatattcttgtaacttagtaatattctcattattgcatggacagacttatactaaaaataattatttgttttttgtcaacaaattgtcaaatttcaaattaaaatgtgacattt

SEQ ID NO: 384691 - DNA, 335 bp, Homo sapiens
tgccaggtacctcaatagaaggaattgaatatggggagattagtacaaaggtgggagacgggttgaaggaacaactgggggcagggagggaaaccagagatgagcagcagcaggaagtcacttcccccgctaggcctgaagggtagagggagcaagtggtgttaccagaatccacagctagggacaccaggcaggagctggtatcacagagttagaggctgctctgtgggagctaaaaacccagaatagcactttgggaggccgaggcagcagatcgcttgagtccaggagtttgagaccagcctaggcaatatggtgaaaccacatgtctatga

SEQ ID NO: 384692 - DNA, 326 bp, Homo sapiens
aagaacttctggctgagttccagactgattctgctggcacagagagctctgagatcataccctatattcagagcacagaagaaatatttcatccatctctgaaataaagaggaagaaatgaagcatatttgaacagttgcagaaaaaaaccataccagggtgaaaagtgaagggcatcctagccatttggagttacagaaaagtactattaatcctaaatacttaagtggcatattttttcattctaagtgtttcactataaactaagcagcttgcataaatctatttcatagatatataaatgaaagcagatttcatgatttacc

SEQ ID NO: 384693 - DNA, 132 bp, Homo sapiens
ctgctcccctagggaagaggaggctggactcagaggccactgtccggagctgcgccggcccctttatgtgcacatgtccaagctccacaggagaacgcagccgcttccttcccttccgcatgcggggatggg

SEQ ID NO: 384694 - DNA, 382 bp, Homo sapiens
tattaagcataaaatatctggcaagaattttttaagtgacaccttgtttcagtgtctgttaaaattctaatgcatttttaataggatagtgatatgttagtttgtaatttagtagtgcaatacgtattgcaaaaatatagcatgtgtgtccctaaaaatcacctcttcatgcaaaatctggaaacaaaaaacgcagggcttggggggaaaatggatctaggagcacactacacaaaaacttcattagtgacacatgggaataaagataggaaccgaataaaaatggtagcataataaatatgacatttggccttgaaaaagacccgcattttgcttgtgaaagtaactgagtgttgaaagggtttcagcatgtgaattattg

SEQ ID NO: 384695 - DNA, 225 bp, Homo sapiens
ccactgctggctgactaaagtccacctggactctccttggctgcaatccccaatgggagctgccggctagagagaactgacttgcgctgccatggcaggataggtgacaggaacgacctgctgggagcctagaccagctccaggagaggtcaccttccaccagtgaaagacactaccaacacttccaccacctctcagtgctgtgggtgaccgggagctgctcct

SEQ ID NO: 384696 - DNA, 343 bp, Homo sapiens
gagaggtcctattttcttttattgccacgccgctgccttggccccgatggtagcatgccatggcctgctgccaaatgaacagcccgtgtggatttttaaaataaggagacaagttccatcactattcccaagagtgcctgccctgattgcaacccaagatagttgcttctagcaagcttggagccaagagacctaggttcaaaccctgaactcagcacaagtccctttacctctctgggcctgtttcttgcctttcgtggataacataaaggcactgcttagccatcaggcactgtgtctggctgtagcaactatcattattgtcatcctcctcatgggctgt

SEQ ID NO: 384697 - DNA, 295 bp, Homo sapiens
tcagacaaggttccagtcctcaaggagctcacagtcacaggacgaaagcaggctcacaacatagggcaatatgtgctgtgaaaactgagcacagggggctgtgagaacacggagcaagggacactgtagagaagggaatgaagcaggtatggaaatggatatagaacaagacatggactgctctgtgcattcaagggcagagagatctcatccagcagggcccatctgcagaggtttcatgaagttaggtggtctttgagttgaaaccgagaggatgcctagggtttctttcaac

SEQ ID NO: 384698 - DNA, 420 bp, Homo sapiens
tcctgttttgttttgttttgttttaccacctacacctcatggctagcctagacaatgcatttccagcattagaggcaggaatgcctagacattgatagaggaaccgccagaaccactaatgagaatgtgttacactgatttgggagatgcccagaaaagcaacaatggaacatgtaggatttgacctcagtaaggaaaagaaacatttctctctcttttttttttagacaaggtgtctctctgtcacccaggctagagtgcagtggtaccatcacagctcactgcagcctcgatctcctgggctcaaggatcctcctgcctcagcttcacaaatactcactaccatgcctggctaattattttattttttgcagagatggggtcttgctatgttgcccaggctggttttgaactcctggg

SEQ ID NO: 384699 - DNA, 724 bp, Homo sapiens
gtcaaaatgagacatctccctgttatgatctgtgtcagcaaggctgtcccactaatcctatcctgtttcgtggtaagctgttttcagagccaactcaggaactcaggtccatccaagcaaagacagatggcaactttttacagaacactttcatcatgtatatgcgatctaatttgatcttcgtagttatagtatctgtgagacgggcactattatttctatttcatagttgaggaaattggctcagaggcgttaggtaacttgtattcagaaccgggacaccactacaattgtgggcttttctgactggtggtgttctcttctttctccaagatgtcacagttctgctcaaataaggagctctgaagcctactagagagactttaagtcctcaacttcccccagggacccgtaaacaaagggtatcagggctgctaggagactataggaggccctaggaatcacctcaccctgctgggtttatgctgctagtgaggaatacctaacctgctcaattttactgcttgttgaagttctaggtttctcatttgtaaggctaaaaaaactaaaaatcatagccactgtctatttaaaaatgaacagtaacattgatagttttaaataaagaagaatgtacaggtccagccaatcttacttggaataagtgagtcaaacagattgttttacaggatggtgaagcttacttaacagtgataatttgcat

SEQ ID NO: 384700 - DNA, 432 bp, Homo sapiens
aatgatattgagcttgagtatgtgcagaaattaacgatgtactaactatctaactgcctaaaataaaaacgggtagtcagtgatttgtattttactgagcagaagtggcaaggtttcttatgtgcagctgagattatgtactgttgtaaatgaaacccaaactctagttttcaggatctgagaagggagctctttgagcctgcatcttcccttcctaatatgagcctacatattccctgaatatctgacttactccctttccaacaatgtcatttttccatttgtagttggtaatatataaccatgagcaatttctaaatcatgttaaactaaactagtgaccatactccatgccaagggccttagaaattattcaagttaggtataatgaaaataataataataatttgtattaccattattactatcatt

SEQ ID NO: 384701 - DNA, 2050 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagagctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagt

SEQ ID NO: 384702 - DNA, 364 bp, Homo sapiens
tgagacagagtctcactctgtcacccaggctggcgtgcagtggagcgatctcggctcactgcaacttccgcctcccgggtccaagcgattctcctgcctcagcctcttgagtagctgggattacaaggctgtacgtgggaggcagcctggccggggactcaatgagaccctgtccaggacctcaactcggccatcacatatcgaattaccaaccactcacacttccggatggagggagaggttgtgctgaccaccaccacactggcacaggcgggagccttctacgcagagtgcggggcagggcaggcgggcatctccaagggtgtggggcttaaagatgtgtctaggagggacaagccccttc

SEQ ID NO: 384703 - DNA, 3110 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384704 - DNA, 2277 bp, Homo sapiens
attctggggctcgggggatcccggacaccctctcagctcctgcccgggggcccatgtagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384705 - DNA, 2805 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgagactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384706 - DNA, 2924 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttagggactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384707 - DNA, 2940 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactca

SEQ ID NO: 384708 - DNA, 2290 bp, Homo sapiens
  misc_feature (2263)..(2263): n is a, c, g, or t
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcctctcctcctctgtgctgtcacagaggagggaaagtatatgtggtactggggaggaggaggaaggaagagtcgcccnctgtgctgtccccctcctctgtgctgt

SEQ ID NO: 384709 - DNA, 1141 bp, Homo sapiens
ccctgctacgagcagctgaacaggaaagcggagggaaaggccacttccaccactgagctgccccccgagtacctgatcagccgcctgtctcagcagtcccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384710 - DNA, 2957 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384711 - DNA, 445 bp, Homo sapiens
cagtgagctgcagcatgacgcctatgagctggacgtcgcagacgatgtcgtcagtgtgagaaccatggctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtagcacccactctgttgccttccctccctgactccggtcattggctggtatgggaaacgctgtaggaagggtccaccccaggctgacctggc

SEQ ID NO: 384712 - DNA, 2375 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384713 - DNA, 3008 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactca

SEQ ID NO: 384714 - DNA, 2229 bp, Homo sapiens
aagctcggttacccccgactagcccgacagtccccgactagcccacagccgccctcgccctccaaggctcttaggctctgtcctccctgaccctccccagggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384715 - DNA, 2374 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagtacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtagcacccactctgttgccttccctccctgactccggtcattggctggtatgggaaacgctgtaggaagggtccaccccaggctgacctggc

SEQ ID NO: 384716 - DNA, 1629 bp, Homo sapiens
attctggggctcgggggatcccggacaccctctcagctcctgcccgggggcccatgtagtcccttctgccctgtgcctcggtgcctgtgacctgagccccttggttgaccctgcactcgtccaacttgggccaaacgactgcccctccttctggcagtgggctggaccagccggccagcgggagcccccttggcagaagccggtcgtaaaggatcataaactggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacctctcccccagccgcacgggcactggaggtctcgctcccccagcctccgacccgaggcagaataaagcaaggctcccgaaaccc

SEQ ID NO: 384717 - DNA, 1036 bp, Homo sapiens
gactgacagacacagacaggcccaaggcccccagtgaggtaacctgtgatgtgtgtaggacagaggccagatgtggggtccagcgaatcccacgattcccacggctgccgctcaccctgcaagtccctgcacctcttgtgagctcctgtgagcagcttggcctcccgggggggagggggtgggcagggtctcgatgggacacacaggccccttgagccagggtcagcagagcctgagatttgggagacagcccaggcctgggtggaacccaagtgtcccaagcctggcacaggttggcacgggaaatgcctggggcactcaacagtgcggggatgatgacgttttccactgcgatgccaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaccc

SEQ ID NO: 384718 - DNA, 461 bp, Homo sapiens
atcatcatccagaagcaaatggctccttaatttaatcaggatctcttattatcaaattattgccttggccacagtgaggctgaaaacaggagcagaacattatcaagctgctcaggaagccagtgagtagtaattactcccccagagaactggtcatcttccgtgtcctacctagtggcaacggagtacagctgagatttataccctcctccacaccaaaataatggatgaaacagacaggctattaaaaataggcctgattctgttcccttttaaccctcacatccttcaaatggatgtctccaggcagttaagtgttctagcctttgcggccccttgttaccgcctgattttgggtgttttacagcaacggaggaacttaagcaaagaaacactatgtggcttgaaattcacactaatccatttagaaataaaagaatctgagaaattttaaataattg

SEQ ID NO: 384719 - DNA, 350 bp, Homo sapiens
tgtctaatttttcacctagaagcttagttgttttgccttttatatttagatcaaagaccaactgaaataaattatgtatagtgtgaagtagtagtcaaaatatatttttcccatgtgagtatccaaccaatttggttccatttctttaaaagactatcccttccctacagttctacagtgaaactttagtcataaagcaaatttccatatatgagtgggtctatttctgaaccctctattctgttgccttgttctatttgcactgacacactctagctttatatgaatgcttgaaatgtggttgtgtaagcattctagtttatcattgttttggctatttgtgggccttt

SEQ ID NO: 384720 - DNA, 280 bp, Homo sapiens
ttgttgctcattaatatttactagataaataatacattggagcttgagtaccactgtataattggttttcccaacattagatttgtttaaagttatccaatgtttcaatagttccaatttctcctactatacccgcaatggatggtttcttttgagacactcagagaaagcctagcatttaagggcgcaggttgtggagatagactgccggggttttaagtccagatcaactctttcctgtcctcatgaccttgtgcaagcaaatctacccttctctgag

SEQ ID NO: 384721 - DNA, 779 bp, Homo sapiens
ccagcccctatattttcacagcatcactgctgtgctacatagatgcttgtgggcatcttcatggaatcacaagtcctagatgaggctcttgtgtggttatattttgtttgtttatttggctagtgtctctttcttttggaaaaccaacttttccccaatccatgtggttttcctaactgttgacttagaatttctggtggtagttcctgcaaatctgaattttcaaaaacacttgagggaattttcatgcaccataaggggtgagaaactcaaatcaaaggaatgagaatgggactcatgtgacatcaatcaaaatcttttcttgaattgataaatagactctgggagaaagaagctttctttctactggggctgccaagtagagaaggagggaacaaggctcttccagcagtgcccttcttcattcagttgggagagtgtgcctacctataggataaagccaaggagagataagcagagtcaaaagaagataaagggccaggcacagtagctcacccctgtaatccaagcactttgggaggccaaggcaggtgaattacgaggtcaggagttcgagatcagcctggccaacatggcaaaactctgtctctactaaaaatacaaaaattagcctggcgtggaggtacgcgcttgtaatcccagctactctgcaggctgaagcaggagaatcacttgaacccaggaggcggaggttgcagtgagccaagatcacaccactgcactccagcctgggcaacagagtgagactccatctcaaa

SEQ ID NO: 384722 - DNA, 432 bp, Homo sapiens
atggtggtttctgcacagacaccctccgtctgcgtattaaacacgcaggaatactcttcccttccacagagaaagaactttgctgtctcgcatttttctggtaacacctagctgtctcgaactgcatctctttttctcgttgttgatagaaacagggacataaagaaagcttcttctcttctaagaggagctgcggccgaagcacaaggatgaacagctgcggatactcggctttggtgccaggaagaccgcggggcgtggcggggaccgggccctgcgaatggagcagctgagactcagctccgcggaatgacacaagcctggggctgccagctcttcccatttttcaaaagaagctggaaatgggttttcgtttaaaataccctggttttcgaatcttggcctgacatgtttttaaacaccgtatgagcc

SEQ ID NO: 384723 - DNA, 587 bp, Homo sapiens
cttccccactgtctgattggcagcctcccatcgagtgcaagcctggggaatcagatatgcagaagcctcctctaaaacagccccctcagtctctgtacccttatcccgtttcattcttcaaagcacttaccgttacatgacatttagagtctatatgatttgtttgtggttggcctatttcaaatgtggactcctctatgagggcattaagtctgacttgatctacttcacactgtatctcctaactcctttcagtgtgggagcaggcagtcaataaatatttgtatgaatgaatgaatgaatcaatcagtgcttgacacagaatgcttttctgggaagaggagctcctgtctctattttgtctaagatctataccagaaatcctcttcatcactggtaaaattttaaggtactatagaggaatataatgacctggtttcagctgtaatttctgtgctgatttgtatatatattatgatagtaacaagggagctaaccccatcactttgggatgctgaggcaggaggatcacttgaggccaggagttctagaccaccctgggcaacatagtgagaccccatctctac

SEQ ID NO: 384724 - DNA, 478 bp, Homo sapiens
gtgcaggaactcctgggatggtgttgcccagtgacacaatcccagtgtggccatttctgatcccgagaaagcagtcaggagtgggtggatgcagttacagttcatcaagtcctgctagttcaagtcatgagtcctgaattctccaggaggagccactaaagaaatgcagaagcaggcaatccttgcaataaggccagcaaactgccagtgtgaaggatgcccaggtaacctgcccatgccagaacggccaggagatggtggaaccagaatctaagcccacgcccatctgacctcaaagtctgtgctcctgaggttcgcaccgagttgcctcctaagacttgctgaaactggatcacgtccatttacccatctctgagagaaatgcaagctttaaaaaaggaaatatttactatggatattttacaatagttccaaaacatgaaagttttaaataagatattcttaaccatcctcacca

SEQ ID NO: 384725 - DNA, 311 bp, Homo sapiens
ccactggggcttcagtaggtgtaaacattcacccctagacactgccatggggtcagagccccacagcctgcccgtctgcatgctcccctagaggttggagcagcagggcactgaagaagcgaatcactcccccgctgcacgccttgcgagggggacaagggaagttatcccctttcaatatgttactcctagccttaatttctggaactttatttttcaatactttaaaatgcagtgttggttaatctgattaaattcacttatatttcacttatattctattataattcataataaatgtgttaattggt

SEQ ID NO: 384726 - DNA, 524 bp, Homo sapiens
ccagggcacggctgaggcaggacgggcagaagtcattcctggggcctgggcgatgctgcatgagctcttcctccaagaggaagtgtccctccagcttggccctgagagcacagtagatcaggactggacagggagcaaggccttggagaggcccccagggatgtgtgcatgtgcctctgccccacgaatgcagctgcgccctgctcactgatgccctctgcagctctctcttcagcccaaagctcttctccctaaaagcctctgggcctttgcccagggagaggtaccctcctgcctgaaagactgcccgagggacggtggctctgccccccattttgcttccaggccgagctgggctggcccgccagcactctgtgcacatgcccctagttatctgaggattacccatctcctgtgtcttccccactggtgtcacacagtgtgtgagcaccctggggaagcacaaaggctgggcaagtgctgacctttggccccgtccccacccctcccacccctactcttta

SEQ ID NO: 384727 - DNA, 393 bp, Homo sapiens
ctgggagggaaggactcttgagcaggcccaaagggactatttcaaattttggatacaagtttccattcacatctgaattcctctttccaggttgtttctctcccctggatgcctgtgggggtggggacggcagagcctcggacactgcccggggatcactctcaggctacttttcccaccctgccaagctgctcgagacgtcaaaggagaccaggccggtcagcacacaggcttctggtaagtgccgccctccggtctgggagctcagctctccccttctgactcaccgctcggcgctgactcatcgtgacggcgagtggggctccagctccgcggcatttcatagacagcgcggtcacattcctttccaacagtcgctctggcctcgatgtc

SEQ ID NO: 384728 - DNA, 288 bp, Homo sapiens
attaccggttatacctatggaatgaagagaatgttccttatctgagttgtaatagcctacttgtaggtctatatttatcttcacagtttgtacatttttttcttgtaatatcaaaatatatgtatatgtactaagtttattttgcaagtgtttcaagaatttgtagtttaatatgcatatttcattgctttcttctccatctgacattatttagacttaggatgaaatagcaagctgggaaacaatgccatagatttaaaaaggcctatgagaagtatagaaattaaa

SEQ ID NO: 384729 - DNA, 389 bp, Homo sapiens
tccaggaactaatgtaatgtcaagtcaatatgatttaccaagtaagtacttaataaatatttctgaataacaaacaattattaagtactaactacttgctaagaacctctgttaagtgctctgcatggaccattttgtatttcactacactaggaggtcttgcagatgaggagaccaaggctcagggagctgatcatccaggcccagggcacacaatggacgacatctggtagtttggctacagagcccaagttctgaaacacttgacattcgtagaaccaatgatcctgaaagaattcagaggttataaaattttcttcctataaactattaagaagtggaagaacttttaagaaatggataggaattcgtggcagtgtattgggtat

SEQ ID NO: 384730 - DNA, 740 bp, Homo sapiens
ctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagatgacagcagccttctgaatctaactccctaccccctggtgagaagacggaagagaaggttctttgggctgtgttgtctcgtctcaagctaggtggctcctcctggaaacccactgagaacatcttgaaaaaaatcaca

SEQ ID NO: 384731 - DNA, 215 bp, Homo sapiens
tatcttatctataacattcattttatattgcaactacttgctttcctgtttatcttcaccactagattgaactctttaagttagtatcttaatccttccgtattttcccagcacctagcacagtgcctggcacgaagtagtgggtaacagttgtatttgttggtgactgtgctgttatcaggttagacttcgtggaggagggatatttagataga

SEQ ID NO: 384732 - DNA, 993 bp, Homo sapiens
  misc_feature (720)..(720): n is a, c, g, or t
atgagatgtgggtggggacgcagatccaaaccatatcacctgaaaatagatacatagaacaatccaacagaatagagcacacagaagtaaatccacacgtttgtagccaactgatttttgaccacagtgccaggaacatagggaaaggacagtctcttcataaatgatgctaagaaatctggctatccatgtgcagaagaattaaactagatccctatctcttaccacatacaaaaatcaactcaaaatgggctaaagacttaagtgaaagacctaaaatgataaaactactagaagaaaacataggggaaatacttcatgacattgatctgggcaaagattttttgggtaagaccttaaaagcacagctaacaaaagcaaaaatagacaaataggattatatcgaacaaaaaaactccttcacagcaaaggaaacagtcagcagaatgaaaagacaacctacagaatggaagaaaatatgtgcaaactattcatctggcaaggggctaatataaggaactcaactcagtagaaaaaagaactaaataaaaaatgggcaaaagacttggttagacatttctcaaaagaaaacatacaaatggccacaggtataggagaaaatgttcaacgtcactaatcatcaaggaaatacaatgggaaccacagtgagacatcacctcaccccgattagaatggctattatcaaaaagaggccaggcncagtggctcatgcctgtaatcccagcactttgggaggctgaggtgggcagatcacttgaggtcggtagttcaagaccagcctggctaacatggtaaaaccccatctcttctacaaatacaaaaattacctgggcatgctggcgggtgcctgtagtcccagttactggggagattgaggcatgagaatcacttgaacctgggaggtggacgttgcagtgagccgagatcatgacactgcactccaggttaggagacagagcaagaccctgtctc

SEQ ID NO: 384733 - DNA, 608 bp, Homo sapiens
atgtgcacacatttgctatctctatctgctgaagaggacatgaagcaaagaaaccccagtagcaagaagccacattgtgctcaggtcttagtttctaacaaacaccattccccattaaaaggaaccagagctccttagagaaatggatgattccagggctgtggcagggtaggtacaagatgaacctaaagtgtcgttttataccagaaagtaagaaagtattaaagtgtttaaaaaagtgatgggagcatatcacaaggattcagaagggataccaactggctaaatctggaacaatttgatcaccaaagtaagtacaataataaattctaagctattgaagtaaaggcatttattatgcgtagtaataataaatagataatgagagagaaatgaggactcatgcttacagtaaaatgccaggagctgactggcataaatgtggaaggaaggctggagtgggaaaattattattttgcaaccatcatggtaattaccagatcagataaggatcaacagatgccaaatctagggcaaatttgatgaggagcagaatatttgcactgtctttgagagtttctcccagagatcacttatttgttgtaaaa

SEQ ID NO: 384734 - DNA, 144 bp, Homo sapiens
caatgtaaaaggtacattatattacatttgatataatgcaacagtaattataactatatatgcaattcgtatctacataagccatgatagtggaggatttcttgaaattactttcttttcccccagtgaaatgtcagttgtttt

SEQ ID NO: 384735 - DNA, 837 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384736 - DNA, 1143 bp, Homo sapiens
tgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctagatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384737 - DNA, 1013 bp, Homo sapiens
  misc_feature (1013)..(1013): n is a, c, g, or t
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccctgtccccaacatgccctgtactaaaattgcgagaagactaacaaaaaaaacaaaaaaattcggaggactctatgccggggtgggggaaagggggactgaaatggccatggccaaagcgttccgtaaccaggtttctggtccaaggggaagatggcggggacccccctatagggggagcgcgaataaattcggaaaagcggcgtacgtagaccgaccgcgacggaacgaagatacacgcagggccgcgagcagaaggagcggagcacacgggcgaacaaagagcaacgacagaaggcacacctacgcaatacactgcacccacagcgacgctn

SEQ ID NO: 384738 - DNA, 479 bp, Homo sapiens
gcttccgagtcagctgattggaaaccactagggggcagaatcttctccttccctgatgcccgggtgtttgtggagccggcggtctgcaatgggtcagcctaactgctgatatggtattaatatttctttcttgttttacagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384739 - DNA, 742 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaattaacatgcgctgtgttgtggactttacttcccaacccaccctaaatggccgtgtgagggacatgggaattgtggagcttggccttccccgcatggaggc

SEQ ID NO: 384740 - DNA, 249 bp, Homo sapiens
gcggccgcctactactactactgctcgaattcaagcttctaacgatgtacggggacaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384741 - DNA, 964 bp, Homo sapiens
ctcagaccggttctgggacaaaaggggccgcggcggccggagcgggacgggcccggcgcgggagggagcgaagcagcgcgggcagcgagcgagtgagcgcgcggcggcccctggtccgcccggccgcggccgatctaggggctgggggctggaggcgggggtgggggtctgagctgcgtcctgggctcgaggcgtcccccggggagtcgcctcttagcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384742 - DNA, 984 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaagctcttcttttttaatataaaacaacgatctataaagagtagaaaatctgggggatattggggggggacaagaggtcaacaggacggggacactatcgtacccgtcttggaggggagaatggggcaccaaggggggatatggacgga

SEQ ID NO: 384743 - DNA, 956 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaaaaatacctcccctccccccgccccccccccccgcgcctcttcccggggcggcgcaacacagaaggccgccctgctccccctttcgaaggggccggcccacgggggtatccagcggccgc

SEQ ID NO: 384744 - DNA, 507 bp, Homo sapiens
ggcagtgcaggtttattctgctggttgactcttgaggtatcctgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384745 - DNA, 706 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagcccgtcgggtggagcggtaccgagctcg

SEQ ID NO: 384746 - DNA, 812 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagcccaaacgcgtcagcgcataacgtgcgactaactgctagatggaaagggtagttgcaggtaagacagggagcgatggccacgaaaagcaatgtgatggtccgagagcacggagggtgctgtgcacgcctacaat

SEQ ID NO: 384747 - DNA, 1410 bp, Homo sapiens
ctcagaccggttctgggacaaaaggggccgcggcggccggagcgggacgggcccggcgcgggagggagcgaagcagcgcgggcagcgagcgagtgagcgcgcggcggcccctggtccgcccggccgcggccgatctaggggctgggggctggaggcgggggtgggggtctgagctgcgtcctgggctcgaggcgtcccccggggagtcgcctcttagcggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgccccccccccccccccgcctgtaaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384748 - DNA, 1589 bp, Homo sapiens
tgaaagtgaaagaggggtggggcgggggcgagcccgggttctgtggcccatttgccctgtggccttgagcaagcccctcccccaggcctcgggggctctcccggtttgggggaaccgggcgaggcaatgccacaggcccagggttagagggggtgggcacttgcagctgccgatgtggctagatctggaacttctcagacggctcctgtcagcgccaagtttcaccaaatccaggcctgcgggctcctcccccaggacccccactcgcagtccctcaagcctgtgctcccggaaaggcactgggcgaccgcacccgtggctttctctgggcgaccgggtcccagactccccccagcacagcagagcgcttccctgcccacccgcggaaaccgccccaggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgccccccccccccccccgcctgtaaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384749 - DNA, 402 bp, Homo sapiens
cgtgaaagcacagaggaggcagcacagaggatgacagcacagaggaggtggacagctggacagcccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384750 - DNA, 1402 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgccccccccccccccccgcctgtaaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaaaaatacctcccctccccccgccccccccccccgcgcctcttcccggggcggcgcaacacagaaggccgccctgctccccctttcgaaggggccggcccacgggggtatccagcggccgc

SEQ ID NO: 384751 - DNA, 887 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaaaaacaccaccaccacacaatactcaaacacaaagggggccccaaaaattc

SEQ ID NO: 384752 - DNA, 1136 bp, Homo sapiens
ctcagaccggttctgggacaaaaggggccgcggcggccggagcgggacgggcccggcgcgggagggagcgaagcagcgcgggcagcgagcgagtgagcgcgcggcggcccctggtccgcccggccgcggccgatctaggggctgggggctggaggcgggggtgggggtctgagctgcgtcctgggctcgaggcgtcccccggggagtcgcctcttagcggtgcgtccgggctagcggcgaggggccgccccaagtcttcccaccgccgccaccttagcagcccgacttggggcctggaaagtggagcacgcggaggtgggagggccctgcacgcggcccccggtggggaaggggacgggccagggattcagactcgggctctcccctcagggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384753 - DNA, 828 bp, Homo sapiens
ggcggacgtgaccgtgagcgtccccggggcgggagggaccggcgcagcgggggcgcgcgaggcagcgatgcatcgactgcatcgatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384754 - DNA, 1284 bp, Homo sapiens
gggccatgaggtccaccaccctgttgctgtagccaaattcgttgtcataccaggaaatgagcttgacaaagtggtcgttgagggcaatgccagccccagcgtcaaaggtggaggagtgggtgtcgctgttgaagtcagaggagaccacctggtgctcagtgtagcccaggatgcccttgagggggccctccgacgcctgcttcaccaccttcttgatgtcatcatatttggcaggtttttctagacggcaggtcaggtccaccactgacacgttggcagtggggacacggaaggccatgccagtgagcttcccgttcagctcagggatgaccttgcccacagccttggcagcgccagtagaggcagggatgatgttctggagagccccgcggccatcacgccacagtttcccggaggggccatccacagtcttctgggtggcagtgatggcatggactgtggtcatgagtccttccacgataccaaagttgtcatggatgacctgggccagggattcagactcgggctctcccctcagggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384755 - DNA, 1216 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaagctcttcttttttaatatataaaagccccttcccaaggagtttgctgtggaaatgtgtttgggagtgggaaggtggggagaaagaccaggctgtagggactggtgggtttcagggggcttggtggtgggtgctctccagagctcatggaaaaagcagaacaattacaaacatttcttccagggcccctgaaagggtgctccccatcaagtcacctaagcctttcggtcctcatctccctcagggaccagggctggggaagggaacctggctgactcactggaaccaccacacccatctcagcctcacccagtcaaaggtcttttgatacaacccacagccaatcaggaaggttctacccatgggggagagcagatgcga

SEQ ID NO: 384756 - DNA, 1283 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaaggtcagcgaaaggagaagggggtggggctgtcgcggggggctgccccccccccccccccgcctgtaaggggacaattccaagttaaaccttaagttttgagtcctggccagtggcttcctgacatcgcctcacttggcttccctgcctggaaaagtctgaagatgggcactacaagagaggccgcaggtgatgctggggacataaatcctccctggcccaaatagggaccaactcaaactactccattggagcatctggcttaggacccagggagagtgtcctggaacggcttgcctttgtcagctctccagccacgggcagcatttggtcagctctgccctttctagtgttgggaggaggtcaaggcccaccctgggcctctcagctcactcgtgactcagcccagcgaggccagcagggcaggggtgaatctgcccgcttctcagccaagaaagggaagggaaaggactagacgccaagcctggatgccaaggagcccctggtgtcacatggggcctggcccacgccctccctctcccaggcccgagatgtgacccaccagtgccttctgtctgctcgttagctttaatcaatcatgccctgccttgtccctctcactccccagccccacccctaagtgcccaaagtggggagggacaagggattctgggaagcttgagcctcccccaaagcaatgtgagtcccagagcccgcttttgttcttccccacaattccattactaagaaacacatcaaataaactgactttttccccccaaaaaaa

SEQ ID NO: 384757 - DNA, 674 bp, Homo sapiens
ctcagaccggttctgggacaaaaggggccgcggcggccggagcgggacgggcccggcgcgggagggagcgaagcagcgcgggcagcgagcgagatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagccctgcacccccaagaccaaagcaaaggccaaagccaagaaagggaagggaaaggactagacgccaagcctggatgccaaggagcccctggtgtcacatggggcctggcccacgccctccctctcccaggcccgagatgtgacccaccagtgccttgttgttggactccgctagcgtaaatcaaacaggagcctgccacagaccgtctg

SEQ ID NO: 384758 - DNA, 954 bp, Homo sapiens
gggccatgaggtccaccaccctgttgctgtagccaaattcgttgtcataccaggaaatgagcttgacaaagtggtcgttgagggcaatgccagccccagcgtcaaaggtggaggagtgggtgtcgctgttgaagtcagaggagaccacctggtgctcagtgtagcccaggatgcccttgagggggccctccgacgcctgcttcaccaccttcttgatgtcatcatatttggcaggtttttctagacggcaggtcaggtccaccactgacacgttggcagtggggacacggaaggccatgccagtgagcttcccgttcagctcagggatgaccttgcccacagccttggcagcgccagtagaggcagggatgatgttctggagagccccgcggccatcacgccacagtttcccggaggggccatccacagtcttctgggtggcagtgatggcatggactgtggtcatgagtccttccacgataccaaagttgtcatggatgacctgggccagggattcagactcgggctctcccctcagggatgcagcaccgaggcttcctcctcctcaccctcctcgccctgctggcgctcacctccgcggtcgccaaaaagaaagataaggtgaagaagggcggcccggggagcgagtgcgctgagtgggcctgggggccctgcacccccagcagcaaggattgcggcgtgggtttccgcgagggcacctgcggggcccagacccagcgcatccggtgcagggtgccctgcaactggaagaaggagtttggagccgactgcaagtacaagtttgagaactggggtgcgtgtgatgggggcacaggcaccaaagtccgccaaggcaccctgaagaaggcgcgctacaatgctcagtgccaggagaccatccgcgtcaccaagcctcctttctcttttgcctattaaaccaatgctcttaacctt

SEQ ID NO: 384759 - DNA, 407 bp, Homo sapiens
aaaatcatgtctcttcattttataataccccaatacataaataaccttgtacactttcctaattatattaaacattgatattaaaagttaccattgcttaactataaagatgccccataatcacagaactctaaaatatttgcttctctctttataggccttacttttatcaaatgtttctcgacaaaagttttccactggggaaattattaacttgatgtcagcaactcatggacttgacagcaaacctcaatctcctctggtctgccccttttcaaatcctaatggccgtatatctcctttggcaagagctgggtccagcagtgttagcaggggtggcagtccttgtgtttgttataccaataaatgctttagctgcaactaaaataaaaaagttaaaggtaaga

SEQ ID NO: 384760 - DNA, 879 bp, Homo sapiens
  misc_feature (17)..(17): n is a, c, g, or t
  misc_feature (41)..(42): n is a, c, g, or t
  misc_feature (48)..(48): n is a, c, g, or t
  misc_feature (55)..(55): n is a, c, g, or t
cagcgcatttattgggntgacacctaaattgacaccacccnntgtggnttttaanaaagcagtgtacggccgattcgggatgttatggcactctacacagcctgcatagaatgaggtaacatgagaacatggtcagcccttaggagctccggtctgcagttttcactatttatttatgacaaatattccacatccgtgattctctctagtcaaaacttctttgagacgatgctgtcggccttggccaatcggagaatcgaatcatctgactcacccatcctatcgccccgcagatagcataagttttaaactggccattaaacctgcccgtgaccttgtcagcctcggccacgttcatctggatggatgcgtggtccttggcaccgatgatgcggttgctagcggagcatttccgcggaacttacaggtccacgaactcgccggcgttgttctgcatttcgaggctccgcctgctgccaccacaccgcgcacgcgagagaaagccgagggtttgtcctcttatgccaagttagggcagccctcaaagcagatctcgaagggaagacgtctaccgagagcggattttgatgtatcactccatgagactggtgcctttctctagcctggagaattccaagggtgcaaagctggctgaagctatttgagacggctggtgaggatttgggccagcagaggggtaagcgttcaggactcgcagagtttgaatgagcaagcatgtctgagtggaccccatggaaagcattcaggctttagttgtcttaaaacggccatacccagagcaagtgtaaaggcagttgtggaaaataatataaaccagttacaatagcattcttggagtgcttacccaggtactaggga

SEQ ID NO: 384761 - DNA, 960 bp, Homo sapiens
gcggccgcggcggcgggggcccggctccagatcaccgacccccacgagcgccggccctgcctgcccgctattttggttccatctcttctgcatatttatgcttgcctgttacattccctggcctctgagtgtcctttggcagtttccaaagcatttgggcaagaaggagcttgggcagcttcacaacaggtttattgggcacttcctagcaccaggcactgcaataagaaatggaggttaaaccatgaagaaacatggctctagcccttagggagctcccggtcctgcagtcaaaacttctttgagacgatgctgtcggccttggccaatcggagaatcgaatcatctgactcacccatcctatcgccccgcagatagcataagttttaaactggccattaaacctgcccgtgaccttgtcagcctcggccacgttcatctggatggatgcgtggtccttggcaccgatgatgcggttgctagcggagcatttccgcggaacttacaggtccacgaactcgccggcgttgttctgcatttcgaggctccgcctgctgccaccacaccgcgcacgcgagagaaagccgagggtttgtcctcttatgccaagttagggcagccctcaaagcagatctcgaagggaagacgtctaccgagagcggattttgatgtatcactccatgagactggtgcctttctctagcctggagaattccaagggtgcaaagctggctgaagctatttgagacggctggtgaggatttgggccagcagaggggtaagcgttcaggactcgcagagtttgaatgagcaagcatgtctgagtggaccccatggaaagcattcaggctttagttgtcttaaaacggccatacccagagcaagtgtaaaggcagttgtggaaaataatataaaccagttacaatagcattcttggagtgcttacccaggtactaggga

SEQ ID NO: 384762 - DNA, 783 bp, Homo sapiens
  misc_feature (10)..(10): n is a, c, g, or t
  misc_feature (36)..(37): n is a, c, g, or t
cacgccgatnggtggtgcttcctgggcactgaacanntgcactgcaataagaaatggaggttaaaccatgaagaaacatggctctagcccttagggagctcccggtcctgcagtcaaaacttctttgagacgatgctgtcggccttggccaatcggagaatcgaatcatctgactcacccatcctatcgccccgcagatagcataagttttaaactggccattaaacctgcccgtgaccttgtcagcctcggccacgttcatctggatggatgcgtggtccttggcaccgatgatgcggttgctagcggagcatttccgcggaacttacaggtccacgaactcgccggcgttgttctgcatttcgaggctccgcctgctgccaccacaccgcgcacgcgagagaaagccgagggtttgtcctcttatgccaagttagggcagccctcaaagcagatctcgaagggaagacgtctaccgagagcggattttgatgtatcactccatgagactggtgcctttctctagcctggagaattccaagggtgcaaagctggctgaagctatttgagacggctggtgaggatttgggccagcagaggggtaagcgttcaggactcgcagagtttgaatgagcaagcatgtctgagtggaccccatggaaagcattcaggctttagttgtcttaaaacggccatacccagagcaagtgtaaaggcagttgtggaaaataatataaaccagttacaatagcattcttggagtgcttacccaggtactaggga

SEQ ID NO: 384763 - DNA, 726 bp, Homo sapiens
agagcaccccaaaaaactaggagaaagaatccaggaaggagcggtagaaggtagggagaaactcacaagacggcattcttgtggaagtcaagtcaagaaagaggaagtggtcaacaatgttggatgctgcaaagaggatgcatactgaaatgtgtggattttgcaacaataacatcaccctgtcgtcactgaaggcaacctcatgagctgctatcacttgctttcatatctcagtcaaggggatcttactgcccttaaccccacagtactatcacttgccatgacgcttgaatattactgcttttgagaaagtcttgctaccacgtgttggccacaacatcagataagctttgatactcttgctctccagctgtgagctgggtcttacctcatctactagatctaccactcacaggtcagatgaaacaaaacactgtgttgtgaccctgaccattctctgttcctcccatttgtcctgagactgaacaaattacagcaaaacttgggttgccttatgaataatggggcggtggccaatgcacacatccttatcttcatccacggagggctcatctaaccacccctggtgtcttcactgcaggtttattgggcacttcctagcaccaggcactgcaataagaaatggaggttaaaccatgaagaaacatggctctagcccttagggagctcccggtcctgcaggtaagttaatccttgttgcgatac

SEQ ID NO: 384764 - DNA, 430 bp, Homo sapiens
agagcaccccaaaaaactaggagaaagaatccaggaaggagcggtagaaggtagggagaaactcacaagacggcattcttgtggaagtcaagtcaagaaagaggaagtggtcaacaatgttggatgctgcaaagaggatgcatactgaaatgtgtggattttgcaacaataacatcaccctgtcgtcactgaaggcaacctcatgaacggagaaagatatgcagctgggtatacagaagaggagcaagaaggaagcgaagatgtggagacaattacaaggacaacactgggctgcaagaagaaaaatttgcttattgattggctggtttgtttccttttagtacggagagacttaagcatggttaggtgccgatgggttagagaggagaggatgaatgtacaggagagttggaacaggatccccaagaag

SEQ ID NO: 384765 - DNA, 1337 bp, Homo sapiens
cctttccaggggtagaatttagcattgctgcctaaatctccatatctaatgattcctctgcagccgtgcccaagacagaaccatcctcaatctggcccatccatttgggcttttactttgggttccccattaaacccctaattccttcctgggcccagaactttctccagagctgctatcacttgctttcatatctcagtcaaggggatcttactgcccttaaccccacagtactatcacttgccatgacgcttgaatattactgcttttgagaaagtcttgctaccacgtgttggccacaacatcagataagctttgatactcttgctctccagctgtgagctgggtcttacctcatctactagatctaccactcacaggtcagatgaaacaaaacactgtgttgtgaccctgaccattctctgttcctcccatttgtcctgagactgaacaaattacagcaaaacttgggttgccttatgaataatggggcggtggccaatgcacacatccttatcttcatccacggagggctcatctaaccacccctggtgtcttcactgcaggtttattgggcacttcctagcaccaggcactgcaataagaaatggaggttaaaccatgaagaaacatggctctagcccttagggagctcccggtcctgcagtcaaaacttctttgagacgatgctgtcggccttggccaatcggagaatcgaatcatctgactcacccatcctatcgccccgcagatagcataagttttaaactggccattaaacctgcccgtgaccttgtcagcctcggccacgttcatctggatggatgcgtggtccttggcaccgatgatgcggttgctagcggagcatttccgcggaacttacaggtccacgaactcgccggcgttgttctgcatttcgaggctccgcctgctgccaccacaccgcgcacgcgagagaaagccgagggtttgtcctcttatgccaagttagggcagccctcaaagcagatctcgaagggaagacgtctaccgagagcggattttgatgtatcactccatgagactggtgcctttctctagcctggagaattccaagggtgcaaagctggctgaagctatttgagacggctggtgaggatttgggccagcagaggggtaagcgttcaggactcgcagagtttgaatgagcaagcatgtctgagtggaccccatggaaagcattcaggctttagttgtcttaaaacggccatacccagagcaagtgtaaaggcagttgtggaaaataatataaaccagttacaatagcattcttggagtgcttacccaggtactaggga

SEQ ID NO: 384766 - DNA, 528 bp, Homo sapiens
gcggccgcggcggcgggggcccggctccagatcaccgacccccacgagcgccggccctgcctgcccgctattttggttccatctcttctgcatatttatgcttgcctgttacattccctggcctctgagtgtcctttggcagtttccaaagcatttgggcaagaaggagcttgggcagcttcacaacaggtttattgggcacttcctagcaccaggcactgcaataagaaatggaggttaaaccatgaagaaacatggctctagcccttagggagctcccggtcctgcagaccccacatataggaaccatcggatccctgtgtacagatgaagaactgagtcttggaaagcttaactaccttgctcacagtcacacgttaaggtctaaagtgagaaattaaaccaagtcttccaatctcaaagactttaaaggaaaagctacaagctacaagaataaagaagttcttcatgtatatttatgggaaaattgctaaggtgtagtctcaagtcctaaaaaagcaaagttca

SEQ ID NO: 384767 - DNA, 566 bp, Homo sapiens
gctggtctcaaactcttcacctcagatgatccacctgcctcagccaatgggtggactgttaactcaaaatacgcacattgaatactgaggaaaatgtatagccatcatcaccagcagctgagatgccagttgagataccagaaatgccccagcatgtaactcctcttttaattcacacacacacacacacacacacacacacacacacacactcatggtaaccagttcaggatggacacagaaacagtcacagtcttttttgggaacacactcccctgtgacacttagatcctaatgctgactccaattccctcctgggacctcccctctccttgcagcatgctgggctttcccttagaaaaccccatgtcatttccttcaatggaacatgaatcagcttcacccacagtgtctgcatgtctctgtccatagcaaacgtttttattaccttaaaatatagatctttaccttaactagccaagacctaggaccctttttccaagctcttttagatgaagtaataaatgcaaatattagagatgtgtatatgtgtataaatatatgga

SEQ ID NO: 384768 - DNA, 582 bp, Homo sapiens
gctggtctcaaactcttcacctcagatgatccacctgcctcagccaatgggtggactgttaactcaaaatacgcacattgaatactgaggaaaatgtatagccatcatcaccagcagctgagatgccagttgagataccagaaatgccccagcatgtaactcctcttttaattcacacacacacacacaaacacacacacacacacacacacacacacacacacacactcatggtaaccagttcaggatggacacagaaacagtcacagtcttttttgggaacacactcccctgtgacacttagatcctaatgctgactccaattccctcctgggacctcccctctccttgcagcatgctgggctttcccttagaaaaccccatgtcatttccttcaatggaacatgaatcagcttcacccacagtgtctgcatgtctctgtccatagcaaacgtttttattaccttaaaatatagatctttaccttaactagccaagacctaggaccctttttccaagctcttttagatgaagtaataaatgcaaatattagagatgtgtatatgtgtataaatatatgga

SEQ ID NO: 384769 - DNA, 318 bp, Homo sapiens
agaaagtctttgttgcttcaggcaagcatcagaaactgaatctgctggggtgttggttggactgtgtggcctctctttatccctctcttcccagacccctcaaaatcaggtgcattctatatccccttaggctagatagacattctatggatgctccggtctgcatgaggaagggaactccaacctcccccaagtcagttaattttaaacattttggtcttttttctgtataatttgggattggtgtaccagaaatgactaaaaacctgtggttttctgagagtgatcctgggactataattttctgaaattaaactt

SEQ ID NO: 384770 - DNA, 669 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggtgaggaaagggcccgccccgccccccagccgttcgggcgttcgcccttccgggcccccctgccctgcttctgtgtgctcagctcgcgtcgtgcagtcctccccacagcgcctgcgacccttcgcctctcaacctgactccttttgcagctcctcccacccgccccacatgaagcccagcccccacaacctcttccttctgcccctgaaaaatggttgagcagcggaggagctggttgatacgtgtaggttgtaggtttttaacttctgctttggtggagtgggaggaaagcatcgaagaccggccccactctcttccccgtccatcattgtctccactggctttctgggtgtccacctataatgggagtctagaaaaattcagtgcttggactctgctttcaaggtaataggctcagtgggcttgcatactaatgctt

SEQ ID NO: 384771 - DNA, 6714 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagttctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 384772 - DNA, 6832 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 384773 - DNA, 5149 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggatacctgggatggctgttctcagagagtacttacggggaacagactgccttttagtaacaagggatacttgggaaatacattggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 384774 - DNA, 5594 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 384775 - DNA, 607 bp, Homo sapiens
atgagattataaattccttgagattcgggattgtccattcactattatattcccagtgcctcccacagattctggcacataggcccaaactgacatttatttgttcagtatttcctgagagtcttaataaaaaactttttgaatttaactgaatgtaagaaatttcttatatataatttctatttttatgttgaaaaaatatttttgaaatattgctatgaaatatttctgataaattgctctttgttcataataggcactgaaagtaaggcaagcagatatcaccagagagactgttcagaaaagtgtctgtgttctaagcaagctggtaagagacgaagtaacttgttcattatgttaaaccttcatggcagatctttctttaaggataaggcactattagaataagaagagatttaaatgacatattaaaattatttatgccctagcatctcctcattctctttccctttcagcagttttcatttgcacctctacccaagacttggtaagagaaaggagatcttatagctattggaaagtaagttgacacataaacaaaatgaggtagctgatatatttcatttatccattttggttttgtcca

SEQ ID NO: 384776 - DNA, 420 bp, Homo sapiens
gtctgtcacctcgagatcttgtccttcattttcgacacaaggtatggtaccttatttaaataaatttatgatgtacagtactaaaatggccaacactgttcttagtgtgctcatttaactgccaaattcagtgtgctaaattgaatgcagattgtggcataccatgctttagttcttctaagatgtacttggccttataactatacaaaattaaaagtgttggtagtgcttgtattgtagaaatttaaaagagcacaaatactgtttacttctttgcaggatagggtaattttttctattgtttttgcaatttcatcgatcatgagattagagtggaaagaaacatgttttgatcttgcagaatattttatatgttgccctgagaatggagcatttttcaataaaacatctatatatact

SEQ ID NO: 384777 - DNA, 6886 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaaccatccatttcaaggccaatactcagtatcagacatgaagttaaggttctcacattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 384778 - DNA, 6873 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcctacagttggacttgacctgtccttctagaagtaccctgtgt

SEQ ID NO: 384779 - DNA, 6788 bp, Homo sapiens
ccaccgatctccctgtgcggccctcatgtgctgtgctcgctgacacccgaagtccgcggctttccgcacacggtggggtcgtcagacccgctgcccttggcggtcgaagtcgtcgtgcgggcccgcggcggccgcccatggagaaggccaggagaggcggggatggcgtcccccgggggcccgtactgcacatcgtggtggtcggatttcaccacaagaagggctgccaggttgaattctcttacccgcccctgattccaggagatggacatgacagccacactttacctgaagaatggaagtatttgcccttccttgccttaccagatggcgcacacaactaccaggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagacaatgaaaagatattatcggactatgggacaacttttgttacagcatggaagaatactcacaactacagggtgtggaacagcaacaagcatccagcacttgcagaaataaatccaaattctgttcagaatagtgaacgtggcaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggctgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagtggaaactaaagtttaaggaagttactgtggcatgttgacgaaggattctgccggaagtaaagggacaagcttatacggggtaagggaaataaaagggatatggggggagagggtttttgaagaaaaattgtcgggaaaaaaaaatgggcgaaataggggaaggtaagattaaagaggatttagtaag

SEQ ID NO: 384780 - DNA, 463 bp, Homo sapiens
gcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaaggtaaagtgtaatattttttatcgaattccttaaagaatttgaaaaatcctttcggagtttaacttttgaacttttggtattcaacacattttcaggtggaaaaatttccttgaaaactgtaaagtacaacca

SEQ ID NO: 384781 - DNA, 373 bp, Homo sapiens
ttttaatgtttccatttttttccagctgacaattttttcttcatgtctagaaagtcattcaatgactacagatattcttctacattgtaacctagtaattctatgatttttaataatactttcttagatgtgtctggatttcaccttataagacataagaaagatagataaacctctttatgttcagatattttgctacttgtttcaataaatttgttgaaagcccctacttttgagaagggagttaaattttctcttaactagttacattgattacctcttaaataattctggagagaatgagagccggcagcctgtttggttattcattttattgtagaatgttgacccctccagaatgggctcttggttt

SEQ ID NO: 384782 - DNA, 418 bp, Homo sapiens
actaagatttttctgttttactctactgtttttaatggagacttgtagatttcagatatggcttatacacattctaaaccctgcttctcagaatagtcatactagttttaacacctctttacacaacttttatgtttatctaacattaaaatattgtataatttggttcagttcaaaagtatgggatggctgttacagctattcagactttcatattgttcaaaactttgtatacaagactttattttttttaattttttttttaagagacagggtcttgctttgtcgctcacaggctggagtgcagtggtgtaattataagctcattgacctcctgggctcaagtaatcctcctatctaagcctcccaagaagctggtgctcactcacagtcacatgctactgtgcctggctacttt

SEQ ID NO: 384783 - DNA, 441 bp, Homo sapiens
ctttagtttattaatcagcaccatatgatgtcacagttttataactcatttatctcatttaattctcatacccaccttgtggaattgttatcactgtcctttacagatgaagaaagaaactccaagaaattaagtagctggcccaagtccacccaactgggatgggcagaaccagggtttgctcttggttgtgcctttctacagcctgtgccttaaccacatctatgtgctgcctcttggcctctgtgtggccagtagattctctcatggctaggctcatcttaattaacatttgttgggtgcctactatggctcaggctctagagatcattgtaaaatccagtccactgccccagctcctcgtgtgtcttttgaacacattagtattgtgctgtgcagaaaggacttctgtgcatatgcctgctattacacttgttgaac

SEQ ID NO: 384784 - DNA, 339 bp, Homo sapiens
aaacactctcaacaggaaagagcatgggctgggatagactgttccatcaggacaggtgggaagagagggtggctcagtcacctgggctcttaagtctatagcaccactatcacttactccaaggaagaccaaggtacaatgtcaatacatgaagcagatgcaaccatgcagagttctagtaatcactctaattttaaatgcctggcactgggatggattcctcttcttcctagaaagcagtagacacttttggtgtctacagtttacaatgtcaactacaaatctcccaccatactggattttcagagagagaagagcaaatttttattcctaaaaaga

SEQ ID NO: 384785 - DNA, 868 bp, Homo sapiens
cccacaacccctttccaagattatttctgcactgtagagaagaagccaggtatcatatttcccagaatcctcttttccgtgttgcttcagtttacagctggccgatgagaggtgctgcatgatattggaagatgggacagaaggaaccagtattctgcagaggcagttgcatgagcagatatgaaatgtcctggaggctcccccagtaagctgagaagcacctgctttcccactatagactgagaccactgatggaagcttcccagagatttgagaattgcagaagcttctgtgagctatgaagaacaacgtgactttgaccttcagactgagatatagctggaggctgctttgaccttctttcccacagctcttttgacctttctaaagccccaaaccctatcttaaaaatgacaaatatggaatgcaaagagcagcttttctttttctgatcatggccttaatgtaatacaatagtgaaaccgtctagcatagtgattaagaacattggctgtagaattagacatatttagtttagcattttgattctaccccaaactggcaaagttactgaatgtatctaaattttaatttgctcatttgtaaaatatggctaataatagtactattttttagctcatttataaagtatggataataatagtgcctattttagggagttctgaatattaaaagaagtaaaccatgtaaagcacttagcacagtgctggatactaacaatcgttattgtgatctaactataattttgcttaaaaacatttgttcaagttttcttatatcatctcctctataaatatgagaatttaacatgaaattttaactctacaagttaaatgggagctaaaat

SEQ ID NO: 384786 - DNA, 850 bp, Homo sapiens
ttttcagaaaaaaaaaacacctctgtttgcatctgtagacaaagatctgttcagaatggttggctttgtgagtttacagctggccgatgagaggtgctgcatgatattggaagatgggacagaaggaaccagtattctgcagaggcagttgcatgagcagatatgaaatgtcctggaggctcccccagtaagctgagaagcacctgctttcccactatagactgagaccactgatggaagcttcccagagatttgagaattgcagaagcttctgtgagctatgaagaacaacgtgactttgaccttcagactgagatatagctggaggctgctttgaccttctttcccacagctcttttgacctttctaaagccccaaaccctatcttaaaaatgacaaatatggaatgcaaagagcagcttttctttttctgatcatggccttaatgtaatacaatagtgaaaccgtctagcatagtgattaagaacattggctgtagaattagacatatttagtttagcattttgattctaccccaaactggcaaagttactgaatgtatctaaattttaatttgctcatttgtaaaatatggctaataatagtactattttttagctcatttataaagtatggataataatagtgcctattttagggagttctgaatattaaaagaagtaaaccatgtaaagcacttagcacagtgctggatactaacaatcgttattgtgatctaactataattttgcttaaaaacatttgttcaagttttcttatatcatctcctctataaatatgagaatttaacatgaaattttaactctacaagttaaatgggagctaaaat

SEQ ID NO: 384787 - DNA, 928 bp, Homo sapiens
agcagagtccctacaacgagtggaacggttagcggcacttgctctatgttctatcgaccttgctgtcggaagagagaaatggcagaatgacatcccccatttggcccgctggaaatgcccaccatcttttgggaagatttactggctgtttatagaatgcctgcctatataatatgaaaaagctgctctcaacttctcccccaaaaccttttaaaagaaaacatttgccacatccagcccttctagagtaaagaggttgccaacgtatgaagtagagttagaaaatcacacaccttgcaaattctcattagtttaaaaagaagtcatagaaaatgtcttctggagttgactttttgaaatggagttattagaccacttctggaagcaacacgtccacgtttgttcaatgggctagaggacatggagcagaagacctgagaaggaaaagaagtgccagtagaacgtatgtctgaaactctcccctttctgcctgaagttagaagactacatgttgaaagtttgctttgagcttggttcttcttgaacatgcagcttcaaatcaatgtctgtctgctcataagttcaaccaaaccaggactgccactggctgctaaagggaagaaaaggctccatgaagaattccagcgtacctcctgccctggcagccattctgctgtttctatggaaacattcaccagatagcagcatgctatactgtgcaagtgaagaagaaggcatcttcctttcatcaccacatctagagtgtgaccacttcacagaatgaaagaatgtggtgaacacagttctttattctgacagataaatcgttcaagagaaaggggccagatgccagtgacattttcttggacttcccagcctttagaaccatgatccaaataaacttgtattgtttataaattaaaaaaaa

SEQ ID NO: 384788 - DNA, 474 bp, Homo sapiens
agagcgctcttcggtaagagcggctggggagaggtccttacctctgatccacttagagcaataaccactttttaaatgtaaaataaaaagacaaatgaaaaggcacatccttgtcttctggtaaatgcccaaatgttgccctctttttctggcaattggcagcaagtcaggatgtgtggaggagggagtcagtttctctccattttggcctgcagcttcttagggacatgcctgccagccaagctggagttggaagggaaatctcaaacagatgggggtgcacgtgtaggagaagaaaatagctgctccatcatcctattactgaggctcccccaaaccaagcttgggctgcctcactagataggtatgcaggctggtacttagtttttaaaacaaagggttttcccctctggatggggctgggtgcttttcctggccaaaggaatacaattcttgtttctccccagggtaagg

SEQ ID NO: 384789 - DNA, 2207 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcaccctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaa

SEQ ID NO: 384790 - DNA, 3103 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcaccctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaaggcacatccttgtcttctggtaaatgcccaaatgttgccctctttttctggcaattggcagcaagtcaggatgtgtggaggagggagtcagtttctctccattttggcctgcagcttcttagggacatgcctgccagccaagctggagttggaagggaaatctcaaacagatgggggtgcacgtgtaggagaagaaaatagctgctccatcatcctattactgaggctcccccaaaccaagcttgggctgcctcactagataggtatgcaggctggtacttagtttttaaaacaaagggttttcccctctggatggggctgggtgcttttcctggccaaaggaatacaattcttgtttctccccagggtaagg

SEQ ID NO: 384791 - DNA, 2298 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcaccctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaa

SEQ ID NO: 384792 - DNA, 2329 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagcagaagaaggatgtgcggatctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaaggtgagggcaagacctgggcctgggtgggccaccctgtgcctcatgctctggtaatccctggactgcagagggggtcagctcggggactggcatggcgacagctgggcagagccagacttggctgctgcctgtgtgacacagggacactgcaagttgattttggatcctctccttttgcagggtgccaggggccagtggtgatttgaaaa

SEQ ID NO: 384793 - DNA, 1164 bp, Homo sapiens
  misc_feature (1)..(1): n is a, c, g, or t
  misc_feature (6)..(6): n is a, c, g, or t
  misc_feature (17)..(17): n is a, c, g, or t
  misc_feature (23)..(23): n is a, c, g, or t
  misc_feature (28)..(28): n is a, c, g, or t
nccttnccctcgcttgnagaagnttgtntctcatgcagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcaccctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaa

SEQ ID NO: 384794 - DNA, 2730 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtgcttgatgagggaaggtagactcttccctaggactgacgagttacggctgccagatgcctgcatgggaagaggtggacatctgcatcttccattggtggtcaaggatgggtgtgggagaaccacacctagtgcaagcctggtactcagtaaatatttgttgaaatgaatgataagagcattggtccccaagccagagagccagaagccatcaccctaatgaccgccccttccttccggtctacaagagctctcaaggctgggtctgccaccactctgctttgcccaagtgtgacagcactggggaggagagacaggataaagggcagatgtcagcaatactaagggcttcctcatgggagggcatgaggctccactcattgtcttgtgacttccatccctgctgaatggggctgcaaggccaaggctccttaggggagaggtccttacctctgatccacttagagcaataaccactttttaaatgtaaaataaaaagacaaatgaaaa

SEQ ID NO: 384795 - DNA, 2661 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaagatatgaaaaccttttcagtgcttgccctcagcagctaagaagacagacagtagagaatgtgagaggatctcatggttctgatgatgattatccaacaaacatctggccctctctacatctcttccctccatctccttgtaccctctggcttactgtcctctctctggcgcactttcctgaagcctcttattaactcccatctccagaagcacctcaacaatgtcagtggctgaggctgcactcagagggatgactgctgggggtagactgggtgccaggggccatgggcccaggacccagtcttggccattcagttgagtgaggctgaaggctgggtttgaaaaggcaaaaagacaagacatccaggcagggcttctcttttctttccacaagggacaagagcttggcttatttaggctacagccctgctgctgctcccttccttcttctgtcctgtttccagccttgcaagaaggctattcacaattaggcctggctgcttctctcatttttttcctcccagtttccaaacaagccctcagtgaacatcattgaagcgtgactgcctgtctgcagggagaaggattccatttttcttctcagctggtccccaggcccacgggcacagggagagggacaactgcagcagtggggaggaggcacagctagctgcacagttctctcttctccttgtcctagtcagatgaaggaggctgcactacaaacccaaattctgcaaaaaaataaaaataagccacaaaactaaaaggcctggccccattctggaaaaggcaaagctgcatgagacacagccttctgcctcctcgcctctcctggactggcttcctctttgagaaaatgcacaaagccctgggagatgacaagcacaaggactgactcaagctgtgtctttcagaccaaggaacatcagagaagctgtggggctgcctgccaggcaggatcatggctgccatcaagccttttctggatccagccatcaaggacatgtttgtggtgtgatgcacacttttgcaagcgtgtaagatgttacctggtttgtctcttttggaaaacaaaaatcagaaggctgcattctagagggcagagaaattcccccgaagactgagctggttgcctgcatcctctatcttctttgacccttatgactgaaagatcatcagtttggaaggtactggtccaatttatttaggaagtatctcttggagtttcagaaatgctagcttggacaactgaaaagtcacatcacagctggcattctgggggctaccaaaacaccccttctggagtagaagctgctggaaggcaggcctgagccattcaccacggacaggaagagcagctctggctatcaccactggcctctggggtcttcatatcttgccatctcatccagggttccatgaaagttacccagggtcctcatgtccttccttagagcctgagtggtgtgaggtgacaggtctctctctccactgcccctttctggtttaaaaaaatggtccttacctctgatccacttagagcaataaccactttttaaatgtaaaataaaaagacaaatgaaaaggcacatccttgtcttctggtaaatgcccaaatgttgccctctttttctggcaattggcagcaagtcaggatgtgtggaggagggagtcagtttctctccattttggcctgcagcttcttagggacatgcctgccagccaagctggagttggaagggaaatctcaaacagatgggggtgcacgtgtaggagaagaaaatagctgctccatcatcctattactgaggctcccccaaaccaagcttgggctgcctcactagataggtatgcaggctggtacttagtttttaaaacaaagggttttcccctctggatggggctgggtgcttttcctggccaaaggaatacaattcttgtttctccccagggtaagg

SEQ ID NO: 384796 - DNA, 910 bp, Homo sapiens
tgcggccgccgggcgccggagccgcgtccccctgcgccgccccgggcctgccggccggaggagccaccatacaccccgggtcgccgagcgcctggccgccccgcgcccgcgccgcgctccgcctgtggctgggctgcgtctgcttcgcgctggtgcaggcggacagtccctcagccccagtgaacgtcaccgtcaggcacctcaaggccaactctgcagtggtgagctgggatgttctggaggatgaggttgtcatcggatttgccatctcccagcagaagaaggatgtgcggatgctgcgcttcatccaggaggtgaacaccaccacccgctcatgtgccctctgggacctggaggaggatacggagtacatagtccacgtgcaggccatctccattcagggccagagcccagccagcgagcctgtgctcttcaagaccccgcgtgaggctgagaagatggcctccaagaacaaagatgaggtaaccatgaaagagatggggaggaaccaacagctgcggacaggcgaggtgctgatcatcgtcgtggtcctgttcatgtgggcaggtgtcattgccctcttctgccgccagtatgacatcatcaaggacaatgaacccaataacaacaaggaaaaaaccaagagtgcatcagaaaccagcacaccagagcaccagggcggggggcttctccgcagcaaggtgagggcaagacctgggcctgggtgggccaccctgtgcctcatgctctggtaatccctggactgcagagggggtcagctcggggactggcatggcgacagctgggcagagccagacttggctgctgcctgtgtgacacagggacactgcaagttgattttggatcctctccttttgcagggtgccaggggccagtggtgatttgaaga

SEQ ID NO: 384797 - DNA, 453 bp, Homo sapiens
ataaacttgttgttgttttgggagataccctgtttagcctgaaaggattgagatactgtaattgctatgggggaggggatggatagaaggaaggaggatttgaaggtgggatggggtcctcggtgaccacctaagaatggtgatagtggtttcggggcggtgaactggactttggctttggctttggctgggttggtcaggtgttgttttaagccctgggaagctgctccaaggtgcaaggttgatggttgatgcctatttaaagaagttctccaaaaagtaaaaacaaaacaaaactcttaaaaaggctacattaggctgggtgtgatggctcacacctgtcatctcagcactttgggaagctgaggtgggtggattgcttgagctcaggagttagagaccagcctgggcaaaaaaaagacccccgcccccacagctctaccaaaaatacaa

SEQ ID NO: 384798 - DNA, 403 bp, Homo sapiens
agtgaaaactgatcaatcttcctgtctgtatttataagccaggccccactcacttgacacaatccatttcaccaagggtggagatggcccaggctgttcctgcaacatggtttagtagaaggtggccaccttctgtcttcaaagctgatgtgtatagggaagaactaatttcacttcattttgcagctcttgagcattgaggttgatgattgctgggagccacagaggagttttccatgtgctaggaagattagacattgaagtctcccctaggaatctaagcccttggacctacacgtacctctgtctgccctgggcagctgtctccaggtggtgtaaaagcagcaggtgaaaaagtagattgctttcttctcctcccagaggtggtttgggattttgaagg

SEQ ID NO: 384799 - DNA, 450 bp, Homo sapiens
tgatttaaatacttactattaaaataaaaatgtttgaaaactactgaccaggtttcccacaacctcagctttcctctacgtaagattttacttgcatctaaaaaatctctgacatacctgttaggatcccatttgtgaggtcctttatcgattacatgattattagtccatgtctgagttagacgctgtctttcaaagccttcatttcaaattcatttagttaccagtttttcacactagataaattatttggagtctttcattagaatttattttcctaagcataagcccctcttttccctataattttcatttgttcttcactgcttaccaaattatgggcaatctctgtatcctggcattttaaatcttcgatcacatggcaccagaactgtctaccactgcatgcctacatgtgccttagagtgcagtagagctgagggccaggac

SEQ ID NO: 384800 - DNA, 595 bp, Homo sapiens
gcttaactctgatctactgagtgttgtcagagcatctgtttctaagacattaagaatggttaaaaggagcttcttggctcatggtcaagtgagtgtttttaacaaagtgagtggtcaaaatactaagtcgattctggtatatctacaacatggatgaacctctaggacttcatgctaaatgaaatgtcagtcataaaaggacaaatacgtcctaatgctttgtgaggcaaaggtggtaggcttgtcaaaggccaggagtttggagaccagcctgggcaacatagtgagatcctgtctctacaaaaaatttaaaaattagccaggtgaggtgacatatgcctgtagtcccagctacttgggagactaaggtaggaggatcacttgagctgaggagttaaggctgcagtgagctatgaatgcactactgcactctaacctgggcaacagagcaagatcctgtgtctaaaaaaaaaaatgaataaaataaagttaaaaggatagatactgtaagattctacttatttgaattacttaaaataatcaaaattatacaggcagaaaataagatggtggttgtcagacttggggaggcaga

SEQ ID NO: 384801 - DNA, 414 bp, Homo sapiens
cctgggtggacaccaccagccaccagtccctggcatgcccagtgatcctggttccctggcttgtaggggctccagagcctgcttcctggttcctcaagggcagatattggacactccttatttgtcaccaaaggatgactgtaggccgtgtgctggcctttctttctaagaagctgctttgagctcctggactcacctgaggctccctgggggatgacactcagttctgtcactgtcaaggatgcagagagctggtggtaggtgggaagcatggtgtccacctgcctgctgaccactggacgctgctccatgctgaagaaaagtgacagtctccaggggacatttcagccatgctgaaagggaggctggcagtggtcatttggcccggatctaacatggcacctcgtctccaca

SEQ ID NO: 384802 - DNA, 2485 bp, Homo sapiens
  misc_feature (961)..(964): n is a, c, g, or t
  misc_feature (1355)..(1356): n is a, c, g, or t
  misc_feature (1481)..(1482): n is a, c, g, or t
tggggttggggaagtgcggtgactgggaaatgctgagctaggggcaggaggcatgggcgggacagtgttctgtgcccccttctagagcctaaatttgttgcccgagttcctccgggaagcgctccgggtagattctcggggccgggagctgagatccctgggcggggagcgggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384803 - DNA, 2286 bp, Homo sapiens
  misc_feature (762)..(765): n is a, c, g, or t
  misc_feature (1156)..(1157): n is a, c, g, or t
  misc_feature (1282)..(1283): n is a, c, g, or t
cccgccccgttgaggctttgagaaaggagtaggagcctagcattccggcagaggaagaaaaacggcccatcttttagagtccgacctctggaaattcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384804 - DNA, 2555 bp, Homo sapiens
  misc_feature (1031)..(1034): n is a, c, g, or t
  misc_feature (1425)..(1426): n is a, c, g, or t
  misc_feature (1551)..(1552): n is a, c, g, or t
tggggttggggaagtgcggtgactgggaaatgctgagctaggggcaggaggcatgggcgggacagtgttctgtgcccccttctagagcctaaatttgttgcccgagttcctccgggaagcgctccgggtagattctcggggccgggagctgagatccctgggcggggagcgggggaagggatggggctgaggacagcgaagaagagggggcttgggggaggggggaaatggaagagagaggagggaggaggtacaagaggaaggagagaagtgcggccagcttgctttctccagtcgggtggccgcggggacccgggcgacgtcggaggccctgccgggaacccaggctgcagcccccacccccgcgctgcgacacgccccccaccccttccggctcacacccccgcccacactcctgagtggtgcggtgcagcgtcggccgaggcagcagagccgaggagagcagtgagggaattcaccctactccacaccagagatgtggccggaatgcagagatgaagcactgagcacagtaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384805 - DNA, 597 bp, Homo sapiens
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataaaaa

SEQ ID NO: 384806 - DNA, 922 bp, Homo sapiens
ggcagggactacgtccgcaccttccagaacgctaggacacagaccaggctctagaagcccggggaaaccccagatgcatgcatactgttttgcatgcaataaaaacatcttttctttttcttcctcagaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384807 - DNA, 2950 bp, Homo sapiens
  misc_feature (223)..(223): n is a, c, g, or t
  misc_feature (232)..(232): n is a, c, g, or t
  misc_feature (635)..(635): n is a, c, g, or t
  misc_feature (1266)..(1269): n is a, c, g, or t
  misc_feature (1660)..(1661): n is a, c, g, or t
  misc_feature (1786)..(1787): n is a, c, g, or t
cccgccccgttgaggctttgagaaaggagtaggagcctagcattccggcagaggaagaaaaacggcccatcttttagagtccgacctctggaaatgtgtgtatgatgtgatgtgtgtgttcattagagaacttgtcctaggaggagtgggggagccgtggttggtgtttgctgtatccctgtcagtcccgagggtctgagtcttgaagggagagatgcgagtntgggatctngtgccaacccccactgccaccctgtcctgagtgggagcagcggcccaggactgtcaggaaagtttcccatccttagtcccagccctgagagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgctatttctgtgtgggggtctctatctggggtgggggatgcttttgtctgagaggagagcctgcctcttgccgcagtccttaagcatccncaggtctgccatcaggattgtcccaagtctgtagcaccccacctctgctccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccagctgtgttggccatagatggacatgaggtcatcctagagaagatagaagactggaatgtggtggaactcatggtgaatgaagaagtcatcttccactgcaacattaaggacttggagttcggaggcgatggtaaactagacccactgtgtgaaaaggccaggatagccgtgctgaatgcctactgatctcctcatggaacaggcatctcaagtcggcacaacagcagctgccccagccattctatgatgcaggcagaagtggctgtgccacggtgtggacactgggctctgctagtcagaacagggcaactcgggcctgacctccagcttacgcagcctcaggattgtcacctggctgcacaggagcccacagaaataataaaaaccacatcatttataacatgtctcaatctcaacccatagggagagccctccaatatcaggtacacattgagctgaaggaaacaataaaatgcaatcaaataaaaa

SEQ ID NO: 384808 - DNA, 2705 bp, Homo sapiens
  misc_feature (223)..(223): n is a, c, g, or t
  misc_feature (232)..(232): n is a, c, g, or t
  misc_feature (635)..(635): n is a, c, g, or t
  misc_feature (1266)..(1269): n is a, c, g, or t
  misc_feature (1660)..(1661): n is a, c, g, or t
  misc_feature (1786)..(1787): n is a, c, g, or t
cccgccccgttgaggctttgagaaaggagtaggagcctagcattccggcagaggaagaaaaacggcccatcttttagagtccgacctctggaaatgtgtgtatgatgtgatgtgtgtgttcattagagaacttgtcctaggaggagtgggggagccgtggttggtgtttgctgtatccctgtcagtcccgagggtctgagtcttgaagggagagatgcgagtntgggatctngtgccaacccccactgccaccctgtcctgagtgggagcagcggcccaggactgtcaggaaagtttcccatccttagtcccagccctgagagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgctatttctgtgtgggggtctctatctggggtgggggatgcttttgtctgagaggagagcctgcctcttgccgcagtccttaagcatccncaggtctgccatcaggattgtcccaagtctgtagcaccccacctctgctccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccagctgtgttggccatagatggacatgaggtcatcctagagaagatagaagactggaatgtggtggaactcatggtgaatgaagaagtcatcttccactgcaacattaaggacttggagttcggtaagccctttggcgatgcttccagccagcaatttgcctcctctgaggagtccctcaatttctagttgaaatgatcagtgtatcatgcctggattcaaattgggtttctttctgagtttgaaa

SEQ ID NO: 384809 - DNA, 2124 bp, Homo sapiens
  misc_feature (600)..(603): n is a, c, g, or t
  misc_feature (994)..(995): n is a, c, g, or t
  misc_feature (1120)..(1121): n is a, c, g, or t
tcaacgccgctctggggacgcgtcaggcccagcgcacagcctgggcagctcagcctgtcagctgagcacgggcgcctcaaggggtgcggccctctcagaaggaaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384810 - DNA, 2114 bp, Homo sapiens
  misc_feature (590)..(593): n is a, c, g, or t
  misc_feature (984)..(985): n is a, c, g, or t
  misc_feature (1110)..(1111): n is a, c, g, or t
cccgccccgttgaggctttgagaaaggagtaggagcctagcattccggcagaggaagaaaaacggcccatcttttagagtccgacctctggaaatgtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384811 - DNA, 910 bp, Homo sapiens
ggaggcctggcgatgcccaagaacgcagtggtcatcctgcgctatgggccctacagcgcggcaggcctaccggtggagcaccacaccttccgcctgcagggcctgcaagctgtgttggccatagatggacatgaggtcatcctagagaagatagaagactggaatgtggtggaactcatggtgaatgaagaagtcatcttccactgcaacattaaggacttggagttcggcaagctcaccccaagtagtgacaagaggaccaccagcagctccaggctgacatttcaccagcttagcagcccgtgtaggatgaaagtttctcctttgcaacagttcccacaaaagacccaggacctgacttgtactgtattggcccagattggatcatgtatccatttccaaaccaatctttgtgacctgggttggccaggcctggatcacatgctcatttctggactagagaagaggggaactcagccctactgaaatcgacaggacagattgtgggaaaggggttcatttcacaaaaggaaaatggtgggtctgtttccagaataagggtgaatagatgctgagtcccccaaaacaaaaattgtcccacatctcccgaacctctccagctagatgtcccacaggcaacctgtggcaaacccaacgtgattctccccagctctgagtctctacaactgtattcccgtgttgaagttatgatcgatgaactacttactcaatttgggaacttggggacagcccccaccatcttctgaagtgaactgatctgcccttttctcaacaatgccagtgctttcgccctgctttgggatttggcatctcttccccaagctgtttaactggattcctatctcgttactctgtctccattatctcctcctgcaaaccactcgccaca

SEQ ID NO: 384812 - DNA, 2790 bp, Homo sapiens
  misc_feature (223)..(223): n is a, c, g, or t
  misc_feature (232)..(232): n is a, c, g, or t
  misc_feature (635)..(635): n is a, c, g, or t
  misc_feature (1266)..(1269): n is a, c, g, or t
  misc_feature (1660)..(1661): n is a, c, g, or t
  misc_feature (1786)..(1787): n is a, c, g, or t
cccgccccgttgaggctttgagaaaggagtaggagcctagcattccggcagaggaagaaaaacggcccatcttttagagtccgacctctggaaatgtgtgtatgatgtgatgtgtgtgttcattagagaacttgtcctaggaggagtgggggagccgtggttggtgtttgctgtatccctgtcagtcccgagggtctgagtcttgaagggagagatgcgagtntgggatctngtgccaacccccactgccaccctgtcctgagtgggagcagcggcccaggactgtcaggaaagtttcccatccttagtcccagccctgagagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgctatttctgtgtgggggtctctatctggggtgggggatgcttttgtctgagaggagagcctgcctcttgccgcagtccttaagcatccncaggtctgccatcaggattgtcccaagtctgtagcaccccacctctgctccccaccccttccggctcacacccccgcccacactcctgagtggtgcggtgcagcgtcggccgaggcagcagagccgaggagagcaggtccacacctctgcatccctgcaccaggactcaccaagacgcccatcctggaaaaggtcccccgtaagatggcagcaaaaactcccagcagtgaggagtctgggctgcccaaactgcccgtgcccccgctgcagcagaccctggccacgtacctgcagtgcatgcgacacttggtgtctgaggagcagttcaggaagagccaggccattgtgcagcagtttggggcccctggtggcctcggcgagaccctgcagcagaaactcctggagcggcaggagaagacagccaactgggtgtctgagtactggctgaatgacatgtatctcaacaaccgcctggccctgcctgtcaactccagccctgccgtgatctttgctcggcagcacttccctggcaccgatgaccagctgaggtttgcagccagcctcatctctggtgtactcagctacaaggccctgctggacagccactccattcccactgactgtgccaaannnnagctgtcagggcagcccctttgcatgaagcaatactatgggctcttctcctcctaccggctccccggccatacccaggacacgctggtggctcagaacagcagcatcatgccggagcctgagcacgtcatcgtagcctgctgcaatcagttctttgtcttggatgttgtcattaatttccgccgtctcagtgagggggatctgttcactcagttgagaaagatagtcaaaatggcttccaacgaggacgagcgtttgcctccaattggcctgctgacgtctgacgggaggagcgagtgggccgaggccaggacggtcctcgtgaaagactccaccaaccgggactcgctggacatgattgagcgctgcatctgccttgtatgcctggacgnnccaggaggcgtggagctcagcgacacccacagggcactccagctccttcacggcggaggctacagcaagaacggggccaatcgctggtacgacaagtccctgcagtttgtggtgggccgagacgnnacctgcggtgtggtgtgcgaacactccccattcgatggcatcgtcctggtgcagtgcactgagcatctgctcaagcacatgacgcagagcagcaggaagctgatccgagcagactccgtcagcgagctccccgccccccggaggctgcggtggaaatgctccccggaaattcaaggccacttagcctcctcggcagaaaaacttcaacgaatagtaaagaaccttgacttcattgtctataagtttgacaactatgggaaaacattcattaagaagcagaaatgcagccctgatgccttcatccaggtggccctccagctggccttctacaggctccaccgaagactggtgcccacctacgagagcgcgtccatccgccgattccaggagggacgcgtggacaacatcagatcggccactccagaggcactggcttttgtgagagccgtgactgaccacaaggctgctgtgccagcttctgagaagcttctgctcctgaaggatgccatccgtgcccagactgcatacacagtcatggccataacagggatggccattgacaaccacctgctggcactgcgggagctggcccgggccatgtgcaaggagctgcccgagatgttcatggatgaaacctacctgatgagcaaccggtttgtcctctccactagccaggtgcccacaaccacggagatgttctgctgctatggtcctgtggtcccaaatgggtatggtgcctgctacaacccccagccagagaccatccttttctgcatctctagctttcacagctgcaaagagacttcttctagcaagtttgcaaaagctgtggaagaaagcctcattgacatgagagacctctgcagtctgctgccgcctactgagagcaagccattggcaacaaaggaaaaagccacgaggcccagccagggacaccaaccttgactcctgccactaggtttcacctcccaaacccagcctctagaacagccagaccctgcag

SEQ ID NO: 384813 - DNA, 691 bp, Homo sapiens
actgatgaggcaactgaggcagcttcagagagttcgagtaacctgcggatcacacaactaggaagtaagagagctggaacttgacgttgggctgttgacctccagaaatggtgttttttccagtactcagtgctgcctctgactccattgtgatggttgattttatgtgtcaacttgactgggcccaggggtacccagatatttggtcaaacattattctgggtgtttctgtgagggcgttttgggtgagattaacatttaaattggtagactgagtaaagcagatggccctctatgatatggccaggcctcatccaatccattgaaagcctgaatggaacaaaaaggccaaccctccctcagtaggaggaaatttcgtctgcttgactgcattcaaactaggacgtcaactttttcctgcctttggacttgaatagaaacatcagctcttcctagatcttcaacctgccaggcttcagattgaagtttataccatcagctctcttggttcttgggcctttggacccagactgtaagtgcaccatccgttctcttgggtcttgcttgctgactcaccctgcagatttggggacttatcagcctctaattctgtgagccaattccttctaatatatctctctatacgcatcctgtctcactggaagaaccctgatacggttaggctttgtgt

SEQ ID NO: 384814 - DNA, 371 bp, Homo sapiens
ccgattattcctttgcactggctaattcatgaagagcagggcttcagctcactacacactggacatgtaatttttagtaataggccattaaaactaaactctaccacaacaaaaatatgtgatacctaatggagttgactgtaccacaatatgctgcatgtatttttatttatagatagttatctgttatccatcagtctctccggctgctgccaccacacaaaatagagggaagcacttatgcatcatgagacatgtttgtttcaggattattaccattatggcagcttccaagttcaaatcatctcagagtagcttaacacactgtgtgtccacaagggcgtcttaacctgtaccagagaaaacaggag

SEQ ID NO: 384815 - DNA, 403 bp, Homo sapiens
gatccactctaattcttgtagactgctctgttgattgctttgtctcttggtttttgttttttgttttgttttacctttccttttttatgtgagttataattttggatttaatgttgggcattaggttatagggctatagcttttaagcctagagatgaacacatttctactggagttgagctaggtttggattctcttgctgttatggtgcaccagtggtttcaaatttgtttagtgttactttgtccttgagtttgctggaagattattctcagtgttcctgctccactcagttttaggccttctctgtgctcttgtgcttcagcagggtctcttcatgttctcatctctcctccaaatgtagattgctattggttgttcctcactgtttgctagcctggca

SEQ ID NO: 384816 - DNA, 242 bp, Homo sapiens
tgtggtggggaggggctgcagggagtcagaggacagggaccgtccctcccagctggaggcctctacatcaagcaagcaggggacctttctcccccagctcttccctcctgtgaccacagtgcctgaaatgcctccattagagagaccagaaaaagggcctgggagaccttggctcactgtggattttgggaatggtggagcaggggaccccatgatcttattacttgctaatatcccaccag

SEQ ID NO: 384817 - DNA, 845 bp, Homo sapiens
tggtcaatgctctgaggaagaaccagtgaaaaggtggatgttaacacagaataagttacaggaagtatagtagaaattatagtagtttggattaatagatttaaggaggtatggtcaataatctcaaatgcctctcaagtgtgtttttgtattataagattttctaaataaaagtttctaaataaaacctaataatatttattttttaagagatagagtcttctattttgggagtggcggagatcgcggtccagtagagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttcccccggtcatgttacctgtcagtactcaatcatcatgtacacagtaagaaattgttttatcttttcactctgaaatgcagggatagaaggaaggcatcaaaaaattaacaatggattatttcatcacaatgttaagtgcaaggtgtcggtacagcaagataatcctagatatttatttgaccttggaatgccgttaggcatatatctacttaaaaattgatgtggctgggcatagtggctcacacctgtaatcccagcactttgggaggctgaggcaggcacataacttgagctacaagttcgagaccagcctgggcaatgtgacaagaccctgtcttttcactaaaagtacc

SEQ ID NO: 384818 - DNA, 165 bp, Homo sapiens
tttcacaaagaatttatgattgcttcaccaggtcactagtgagctaaagtcaaggaatgactacaatcttgtagcattttaaagtgattagaatttgagaaacttttactacattatgtgttactatcataagaacactcctttggggacatttgaataataaaa

SEQ ID NO: 384819 - DNA, 447 bp, Homo sapiens
aaaatgagctgggcatgtgcctgtagtcccagctacccaggaggctaaggcacaagaatcgcttgaacctgggagatagaggatgcagtgagctgagattgttccactgcactccagcctaggtgacagagccagaccctgtcttaaaaaaaaagttctgtgtgaatggtttttcaagtagcgctttgtcctactttccccatcttaaaagaaattggcttatgtatagtgattagagatggattttcatcatagatacaaactacctgaggaagtaaaactgtcacacacagacatcaaaactgtgagtgagaggagttcactgcagtgtgcagtagacagggaatgcttccccagaattacaaagttgtcagttatcccttgctaataaatccagtgtgtatttttcattcatcttgtaaaaaataaaacataatcagttaattt

SEQ ID NO: 384820 - DNA, 511 bp, Homo sapiens
ggctcaggtgatctacccgccttgacctcccaaagtgctagggattacagtcatgagccaccatgcctggcagggacacttattatctctgataacaggaagtctgaggtttgttaatttagtggctcattgtcaaatggcgtagagcctttgcatccttctgctctgttcttttatgttggttttgtcttcaagcttgttccccttatgaaagcctggctgcagccattttgagcatcaatccagacgtgacaatatctacaggcaggagaaggatcgcctcctgtgtgtcctttaaagaacaaggtgttaacatgccaggaactgtggctcctgactgtaatcccagtaatttgggaagccaaagtaggaggatcgcctgaggccaggagttccagaccagcctgggcaacatagcaagaccctatctctataaaataaaataataaaaattaagaaaacaaggtgttaaaagacaaaattaaagcaaatatagttttgcagattgtaa

SEQ ID NO: 384821 - DNA, 318 bp, Homo sapiens
agttagagtactaaagaggaaagaaccgtccaaagattccccttgccccagtcggtactcagcagaatactgatcagtgcagtcatgtgtgtggtaactactcaaggtcaagagaaacctatctgaaaggattcgaggatagtgcctgatgtgtgttctgggctgagaacagtgcctgttttcaccagttagactggcaaaacacatacaggcctatcttaatttattgtgctttggtttgctgcactttgtagatattgcttttttttttttttaaacaaattgatggtttgtggcagcctgcatccagcaagcctg

SEQ ID NO: 384822 - DNA, 745 bp, Homo sapiens
attgaataaacggcatgtttcaggatagagaagtggtttggaggaacaggtgattcctgtttgaaaagtggcagatagagagagttgctctgctggaaccccccggccccggcactagctaggctgcaactggtgatgaccctcatgaggaaatgggactcattaataaagagcctcaacttaaaaattgttgggtggagtggcgcacgcctgtaatcctagcactttgggaagccaaggtgggcggatagcttgagcccgggaggtcaagtctgcagtgagccaagatcatgccactgcactccagcctgagcgacagagtgagaccctgtctcaaaataaataaataaataaaatcaaaattggcaatttatatttgatatggacaggtttgatatagttcgttcccacgacttcctagtcacgtaagtacggtcatttttttctgtggggctggatggaggatgtagattctggaggaaataaaagtgtgtagagaatagatgaattacctagggagaggataattgggccaggattgtgactgtgggaatgcagagagagaaattagaacagaattgtaggggaattggttacaaatgggtctgggcatagagtaatgaagagatgaaaaggatgtgctttgaaaactacaagagtttgcagctcatagcactgaatgagttacacgctctgaatctttagttagcaaccactgttttctaaaatgaaataaagagaagaa

SEQ ID NO: 384823 - DNA, 495 bp, Homo sapiens
tttcctgctactttcctgcttggtgtcttgcctttgaggtgatgttttcctcagacccctctgtgtccttcttgcttcctgggggacctttgtggaactagaaaatagctgtttactagcctggagcaaggagcctgagtggtgagccggctgcataaggaaggcacagcagctcatgcttccctaatgcttcactaaacatgcaagacacaaaaggacccagagggctccagcaagggtctggggaccgaacgtctaagcttggaaactggctggacttgtatgggtaaaaccaagagtttttgtcttagctctcccgcctcacagctttgaactgggggtggctcttggtctgcatttcacatgcacggcacctggagaagtgctgtagcctggcacctctgtggggttctggccctggcggagactttgccggccacggcttctccaataggttgctggtggcatctccagcaattggtggtcattgagttg

SEQ ID NO: 384824 - DNA, 408 bp, Homo sapiens
gcctcccaaaatgctgggattataggcataagccactgcccctggccttgctttcttatgcttattgtttgcaggtgtatttttgtctactctttaactttctagctatctaagtaaatatttataaagcatgtctcttatcaacagtcttctagagtctgctgtttttttttttgtttttttttttaatggagtctcgctctgtctcccaggctggagtgcaatggcacaatcttggctcactgcatcctctgcctcctgggttcaagtgattctcctgcctcagcctcccaagtagctgggattacaggcttatgccaccatgcctggctaatttttgtatttttgtgttttctttagtagagacagggtttcaccatgttggccaggctggtctcgaactcctga

SEQ ID NO: 384825 - DNA, 604 bp, Homo sapiens
acccaggagccccgcgtgggccacacccaactcagagccggcctgagcgttcacggccaggcagcctcgcttccttgcagccaagggctgggggccaggctgctgttctgcactctggggtgggtgagggggaccctgggctgtttgctgtcccaagccccttctggaagttagaagcagcaaagggcccggggaagccgggcatgtgagaggggtgcgtccccaggtcccccagagggccctgtcgccgaggacctttctgaaggaagcagaagacgccatttcctctacttcacactgaactgtcccagccactgcatctagggggcattgggcggaagatggtgcatttccatggaccattttacacttaccttttaaagcaaagcctcattttctaaacccctgacttgtgaagcacaattcagcctccgggctgggccacgtggagagagaggatcttctcagcaaggcgagatcccgggcggcggctgacatcaggagcgccaccctgcgtcctttgctgctggttccttactggtttgtacggtcagcgctggaaacttctattaaatggatgcattctggaggcatgaagttacaa

SEQ ID NO: 384826 - DNA, 814 bp, Homo sapiens
gtaaaccaggtataaagaaatatgtctgtgagctcctgctctcaggtggctagctaaacgctcttggctacctcctggtcccaccatagggaaggctccctgcattacattgaaagtcatttatatttctgtgtctattcaccctaggtcttggtgaatgtgaagctatatggaacctttctagacaaagcaaatcataccttttgcaaatatagtaattgtctccagcttcccaataaaaggacaaagtataaaaaacaaacagaggccaggcgcagtggctcacgcctgtaatcctagaactttgggaagctgaggcaggcggatcatctgaggtcaggagttcgagaccaacctggccaacatggtgaaaccccgtctctactaaaaatacaaaaattagccgggtgtggtggtgcatgcctgtaatcccagctactcaggaggctgaggcaggagaatcgcttgaactcaggaggtggaggttgccgccacttggtgagccaagattgcgccactgcactccagcctgggcaacagagagagactctgtctcaaaaacaaacaaacaaaccagaaacaaaggagaatgaaaggatcgtcaaacttaggagaaaaacagaagaaatgcacatgagtgtatttgagtctaatgacctgtttgcatccactaagtcagagttttccaagccccctcacctgctccctttgtcatctttgaactgataccagggaaaaacttaattggtaaatttgaataagatgaagtatattgagaaatgcagaataaaaatagaaagtcaaaattaaggaa

SEQ ID NO: 384827 - DNA, 532 bp, Homo sapiens
cccgctatggtttccctctaacgctgtgtgacatcatcccccagttaccttttcctagaaaggggtgaaagttgtgctgggcacagtgggcaaaggagtgtacatgaagggccaggggccccctgggccaggtggcaaaaggctagacagtaagatggaccaggcctttctgatgtcagcctggactgaaaactgctggagttctcaggcagggtcaaggaatgctgttccgggcctatatggaagccacctgctcatctctcacccctgtacctaccccaaagccttgtgtggactgggattctagagctttctgccaagccctcgcatttggggtttggcaccagctcctctctgccctaatgggctgggttgccaagccagtgtctgctgagtggccagatgtctgcccactgcctgtttctctcgctgggggctgcagggggaggcctggcatcccaagctgaggccagaggctggccaggctgggagacagccagccctgatattatcacagaccttcagagggcgg

SEQ ID NO: 384828 - DNA, 2038 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384829 - DNA, 314 bp, Homo sapiens
  misc_feature (18)..(18): n is a, c, g, or t
  misc_feature (51)..(51): n is a, c, g, or t
cggcacgaggctaggttntgttaccccatcctccctccccctcggcagtgnacacatttactctcctacagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384830 - DNA, 2004 bp, Homo sapiens
gggctgtgagcgtaatccatggacggtgggcgttcgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384831 - DNA, 1877 bp, Homo sapiens
ttcccaggacaggggctggggtcttctgggatcctggggaagtagagcccctcaggcctctgcttgcccttttgtctcatctaggctggttgggaaccggtctgtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384832 - DNA, 1970 bp, Homo sapiens
ttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384833 - DNA, 2059 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagttcccccatccctacccccagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384834 - DNA, 2316 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacagggtgagatgccccttttcctgtcagcccccttttgcccttgaagccctagacagaggctcagcttctgatgtacttaggccttggtggtccctgctgtgctgctctgaaaccctcagtccttccctctgctgccagctccagcctcttcctaacaccctctgtcttcctcacgtagagctgggtgcctgctaccctgtacccactcctctcctctccctggacctccccctactgataactctcctcccttcccccatggcctggggctttgccaacagtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384835 - DNA, 1496 bp, Homo sapiens
tcaggcagtagaggctgggtgtgaatcggccgaggctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384836 - DNA, 2046 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtgattcatgtaatctttcacgatactagattttgcatgaccttacctgggtgagccctctgtgtgtatttgaaaccttagaccctctatggcaacaaatgagatccccttatcattgtataaaacctgttgtgttcatctatggggaga

SEQ ID NO: 384837 - DNA, 1319 bp, Homo sapiens
taaatacaattccggatttattaaaaatcagggctcccctgctgtgccctcctggcactaaggaaataaataaccagagggggcacagctaggtaaagggggaaaaaatcagatctcaagacagactctttgaactaccctttctccctccccaattcccacccccttatggctcttgggacatgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384838 - DNA, 1221 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagtggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384839 - DNA, 523 bp, Homo sapiens
ctagaggatcctacagaggacaaggaggcagacagtatgagtcatgaccaggggagcaggtactagtcatcctccagaaagagttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384840 - DNA, 412 bp, Homo sapiens
gtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaaggtagcctgttccctcccaccaggccagtttgcaaacgaggcccctgtttgccctggagggcatgcacaatgcccagcctgtaggggtgcacagagctgctctgtgcccgcaagaagtgttccctccccttccggtggcaagccagacctgtggctgagggccagtatccctccaccaggggaaaggaagcagagccccagggacagcctgggattgagcaggctgattggct

SEQ ID NO: 384841 - DNA, 266 bp, Homo sapiens
ggcccagcatgccacctctgagtgccccaagcgcactcagccctgcacctactgcactaaggagttcgtctttgacaccatccaggtgaggccttccctgaactgtgggttgcagggtaggtgacaggtagtcaggatattgactcctgcctctctacttctgtggccccagagccaccagtaccagtgcccaaggctgcctgttgcctgccccaaccaatgtggtgtgggcactgtggctcgggaggacctgccaggccatctga

SEQ ID NO: 384842 - DNA, 2074 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaaaaaaaaaaaaacacacacacaacccccacagcgggc

SEQ ID NO: 384843 - DNA, 2927 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcaaaaaatgccttac

SEQ ID NO: 384844 - DNA, 2895 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctaagctggcaatggcacggcatgtggaggagagtgtgaagctacacagggcctccattaccgtcactggtgaaatgcggctcacctcccagatttgttgtaaagattaaatgaactggtcagcaaaaaatgccttac

SEQ ID NO: 384845 - DNA, 2097 bp, Homo sapiens
ttcccaggacaggggctggggtcttctgggatcctggggaagtagagcccctcaggcctctgcttgcccttttgtctcatctaggctggttgggaaccggtctggtgaggaagggaggctgcctcagtggagggggtggggccaggcctccctttcccctaatgagaaacctttttcctgcccctcccccatttcagtgaaggagtcttcaagtgccctgaggaccagcttcctctggactatgccaaggtgagtccacactgccaggaagaagcccaagcacagtctgttgcccttggaggccggagctgctggcagccagtgggctcagggccagtgtcaaccaaaagccttgggatggtgcgcctccacaaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384846 - DNA, 2107 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacaggtgaggctctgatgtgagggctggcaccacctctcccttggcaggcactaattgcagccttcccaccagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384847 - DNA, 2427 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgtttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcaaaaaatgccttac

SEQ ID NO: 384848 - DNA, 1617 bp, Homo sapiens
  misc_feature (16)..(17): n is a, c, g, or t
aagtgctggtactgcnncggagtcggcgccgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaacctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagcaaaaaatgccttac

SEQ ID NO: 384849 - DNA, 795 bp, Homo sapiens
gagctgcaggtatttcaggtggccctgtagcttcaatgtcttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaa

SEQ ID NO: 384850 - DNA, 319 bp, Homo sapiens
ctataaaacaataacacaatgaagaaaacaacgtatgtaggtaacaattaacatgatgactgaaacagtacctcacatcttgatattaatgttcaacataaatgggcctaaatgctccacttaaaagatacagattggcagaatggatacaaaatcacaaaccaaatatctgctatcttcaagagactcacttaacacacaaggacccatataaattcaaggtataagggtgaaaaaagatattccatgcaaatggaaaccaaaagtaaacaggagtagcttttctcatatcagataaaacagactttaaagcaacaac

SEQ ID NO: 384851 - DNA, 186 bp, Homo sapiens
gttgaactgaactaaactgaaggggacatagaaacagtctgggcaaagcagggaaccagagttgctggtcattccagtgacaggcacagaatgtcccttctgtgcagtgtgctaaaggcctgccaaggatcctagatgctttaaaacatttttcggctgggcacggtggctcacgcctgtaatccc

SEQ ID NO: 384852 - DNA, 1302 bp, Homo sapiens
tatttttctgttcattttttaattgagcaaatgtctattgaacacttaaaattaattagaatgtggtaatggacatattactgagcctctccatttggaacccagtggagttgggatttctagaccctctttctgtttggatggtgtatgtgtatatgcatggggaaaggcacctggggcctgggggaggctataggatataagcattagggaccctgaggctttaagtggtttctatttcttcttagttattatgtgccaccttcttagttattatgtgccacctcccctatgagtgacgtgtttgatcactagcagaatagcaagcagagtatcattcatgctggggccagaatgatggccggttgccagatataactgctttggagcaaatctcttctgtttagagagatagaagttatgacatatgtaatacacatctgtgtacacagaaaccggcacctgccagacagagctggttctaagatttaatacagtgctttttttcctctttgaaatattttactttaataccagtgccttttcttgttgaacttcttggaaaagccaccaattctagatcttgatttgaattaatacacacaatatctgagacacttacacttttcaaaagatttgtgtatgcattgcctaattagagtagggggagaagggcaactattattatccctattttacaaaactgaggcttagtgaggttcagccacatgcctagacttatatactagttagtggtgcagccagggagaggactcagatttcctggaggcaaagtctatctctgaaactccatgaagacttttgcagccagttcccaccaatatgccccagacgtgagacaaacaaggacttttttttttatatagagccatccataaaatcctaagcccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgatggctttctagccaaagcgaagcttgtacaggttgagtatcccttatccaaaatgctgggaaccagaagtgttcaaattttagattattttcagattttggaatgtttgcatatacataatgagatattttgggaatag

SEQ ID NO: 384853 - DNA, 660 bp, Homo sapiens
  misc_feature (14)..(14): n is a, c, g, or t
  misc_feature (32)..(32): n is a, c, g, or t
  misc_feature (54)..(54): n is a, c, g, or t
  misc_feature (82)..(82): n is a, c, g, or t
  misc_feature (87)..(87): n is a, c, g, or t
  misc_feature (103)..(103): n is a, c, g, or t
ttttgcagtacctnttttaaccccgaaacccnggaggggaggtgaatatcaggngcatccgggtgagtttggggaacccagnggaantgacattttgtacagnagaccctgagaacaccagcatattccccaggccgggagttttggttttcgcaagtgtcgggatggctggaggatgaaaaacgaaaccagtcccactgtggagcttccctgagggtgcccgggcaagtcttgccagcaaggcagcaagacttcctgctatccaacccttttattaatgtataaccaggagaacatctgtgccaacggttggactttttatggctgagattcgggaggaagtgtgacaccaagcaggagaggaagaatgattttctttgtacttaggttttctaaggacattgttttaatctgtatcgtgccaaagttgtatcactgttaaacttctgaagacataaccagttgagtcttatttcaagatatgttctcaagccaattgtgtgcttctcttgtttctgtgatggctttctagccaaagcgaagcttgtacaggttgagtatcccttatccaaaatgctgggaaccagaagtgttcaaattttagattattttcagattttggaatgtttgcatatacataatgagatattttgggaatag

SEQ ID NO: 384854 - DNA, 3938 bp, Homo sapiens
  misc_feature (11)..(11): n is a, c, g, or t
  misc_feature (13)..(13): n is a, c, g, or t
aattcggcacnangatgagtatagggctgtttcttgcagggttctttcgaaattattgctaggttgacttttaactaaatccaagtgatgttatttgtaatgtagtacttaaatgtttttcttgttgttttagccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatatcgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaatttatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 384855 - DNA, 896 bp, Homo sapiens
  misc_feature (729)..(729): n is a, c, g, or t
  misc_feature (737)..(737): n is a, c, g, or t
aggcgcgcatgcgtgcagctctttggaggcggtagctttttcggcgtcgagactggaggctgagtgctaaactgtgtggggcgcggatgggatccagctgttagtcgggtaggcataggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaaatntgagatgnccttgtgagtaccgggttgttaagggttctcaggaagttgaaaaagctgtatgggggttttaacgatcacggggtggaaagggaattctggaggggtaggcaaaagcaagtagggttttgatgaaaaaaggggaatggggggttgttgtacgtggaatg

SEQ ID NO: 384856 - DNA, 763 bp, Homo sapiens
  misc_feature (712)..(712): n is a, c, g, or t
  misc_feature (718)..(718): n is a, c, g, or t
  misc_feature (721)..(721): n is a, c, g, or t
  misc_feature (725)..(725): n is a, c, g, or t
  misc_feature (729)..(729): n is a, c, g, or t
  misc_feature (736)..(736): n is a, c, g, or t
ctaacgaatgtgcgtgtcatccttgcgcaggggccatgctaattaccgtatcattccaattttagtatatgtgctgctgaagggagcgtttttctattttattattgttgatcttttactatgtctaatttataaattaaactttcatgtatatacaggaaaaaaaacatagtatatatagggttcaccatgagcacggtttcaaggcatccaccaggggtcttggataaggagaaactgctgtagttaatgataagaaaatgcagatgagttgtgaaagatgagatgtaaaattaggctgtgtaatcacaaattgaaaaaaatgtctttataaataggaaaaggtaataatcatgtgtcctttagaataggaagattttagatttttgttctatattttctaaattgctttatactaaatttcttttgttcaaaatatttttcctacgtagaacaaagaggtgaagaaaaagactttagagtcaaagaaagtatctgcatctaccttaaaaagagatgcagatgcttcaaaagctgttgaaattgttacttcaacttctgctggtaagtggttacttttaatattctttcaaatgagtgtatctgtcaggttagtagaaacttagatgatgatgctatgaagacactatgtgcttaatgaaggagacccaattacattcttaattggcctgtttaagcaggggttaataanggcggnatncgancctntgggtantcaccactggtggcagtctggaaactc

SEQ ID NO: 384857 - DNA, 902 bp, Homo sapiens
tcctgggtgatttctttcctgtcagtctttaaggacatctcccttacgtacataaactcttctatccccttgagtatactcttctcattttcttatattatttaacagttaccactaatcatccggtagagtagttcttaaccctgtcttctcttttcttctgttcaacataattcagatttagataacatccttccccttttcagccaatcagtggcggatccatattagttttccactgactctacttcagctctcaaattctttatatgtagctccatcatgcctgtaactccttttaattcagacctgtcgtctcacatttgaactttggaagatagcctcctgactggtattttttattccatactctgctttattatacacgttgttgcccagaggtctctttaaagcagatctgatcattctacttctagcaaccagtggaataaagtccaaattctttggctttccataaattattctttgccctttgaccccagattatcttttgaacctattaacagtcaactgtgtattattttgtagtcactcagaatagtttattttccatgttacttcattccttggttctttatttatgctgtctatttgcatggaattgatggctgacttcatttaacttcagtaagcacttaataggtcgcaggcaaggtactgaagataaaaagtcagttaagacttcttttggggagagttggaggacagattctgatttatcctgtaaggctcatctctgatgaaacttccttgatcgaatgatttttttctcttgttatggcttttctcttttttagaaataatatgtccccttttctttttaccttttcagttcccagctgaaaatgacattcttttaaatctaagtataaaagtaatga

SEQ ID NO: 384858 - DNA, 545 bp, Homo sapiens
atcctaccagtttccatttcacattgggaaggttgatcatttcagttaaccatgttaggtttttgtaggagattggtcagggtggtgggaaaagttataaggagagacgcaaaccttcttggaagtcctgggaggttttgcaaagcttcgggagagaataaaggctgaaggcagctaaattctcttaccctgaggctaagggcaagtagtaggtaacaaaggagtgtaaaggaatttatctagataagtttatttacttttgccgacctttgatcatccgacctttgatcatccgacctttgatcatctgacctttgatcatctgacctttgatcatccgacctttgatcatctgacctttgatcatccgcgtgcaggactgctccctacaggcgggggcaacaattacccacagattgtgttggctccaggcctttgtcattaaatctgtactaaataaatacaagcagctccagcttattggggctgcgttctctcttcggcgtctctaaggccgagcagtttcctagctgcgctcacgcaaa

SEQ ID NO: 384859 - DNA, 3555 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgagtcggtggatcagactcagcagctggtgcccctcgtgaggaacactgcaagggatcacgacggaacccccgaaaatgaaggcgaagagactgtgcagtcagccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgca

SEQ ID NO: 384860 - DNA, 4151 bp, Homo sapiens
  misc_feature (3602)..(3602): n is a, c, g, or t
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccngaattagaaaaagaaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaatttatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 384861 - DNA, 2843 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagccaggcatggtggctcacgcctataatcccatcactttgggagaccgaagagggtggatcacctgaagtcaggagttaagtccagcttggccaac

SEQ ID NO: 384862 - DNA, 3881 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagtattacagcgtgaaataaattcccagtatttttcaagattatgtaaaaggagttgtaattactgctcagcacctaggacagcacccagtgcaacacaatgtacatgaactctggcttgaggtttggggcttgtgttctgcattcaggaaagaaaagaagagaaagtttttgggaaatttaaatcttcgtaagcccttactctaaaagtatatgaaatgcagaatggtttcatggctttatttcaaaatgttttacactggctgtagaacccacttcatgaagtagtttgagttaaaatgatctaatatttgtgttttaactttcagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgagtcggtggatcagactcagcagctggtgcccctcgtgaggaacactgcaagggatcacgacggaacccccgaaaatgaaggcgaagagactgtgcagtcagccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgca

SEQ ID NO: 384863 - DNA, 2108 bp, Homo sapiens
aggcgcgcatgcgtgcagctctttggaggcggtagctttttcggcgtcgagactggaggctgagtgctaaactgtgtggggcgcggatgggatccagctgttagtcgggtaggcataggattggattcagcatcaaaatacatctactcatattgagagctgtcgacagttacgtcaacactcactgcaacctccacctcctgggttcaagtgatcctcccacctcagcctcctgagtagctaggaccactggtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgagtcggtggatcagactcagcagctggtgcccctcgtgaggaacactgcaagggatcacgacggaacccccgaaaatgaaggcgaagagactgtgcagtcagccctctttggattccagtacgatgcatcagaccataccatggcgtggctaggacccaacacagtaccagaagtgaaggaaatgatcctgcaggacccgcagctccagacaacacagcttcctcagacgacacaagccccggacattacctgggggatgctgaagaagacaacttacaaggctgagcaaatcctgctccagacacagaaaccattcactccagataatttgttccttgctctgctctctggtgatgcaaagccggaatacgagcagtaatcgctacgcctgacaaacctgctgctgtgcacatctgtactcttcaatcaacaaaacctgatgcaaaaaacaaaagggggagatgtaggagatcagtcagggtggtgggaaaagttataaggagagacgcaaaccttcttggaagtccaggaggttttgcaaagcttcgggagagaataaaggctgaaggcagctaaattctcttaccctgacgctaagggcaagaagtaggtaacaaaggagtgtaaaggaatttatctagacgagttttatttacttttgcagacctttgatcatcctattgcgcgcaggactgctcccaaggcggtgggggtgacaattacctacagattgtgttggctccaggcctttgtcattaaatctgtactgaataaatacaagcggctccagcttatcagggctgcattctctctttggtgtctctaaggccgaacagtcccctagccgcactcatgca

SEQ ID NO: 384864 - DNA, 2018 bp, Homo sapiens
  misc_feature (1469)..(1469): n is a, c, g, or t
ctaacgaatgtgcgtgtcatccttgcgcaggggccatgctaattaccgtatcattccaattttagtatatgtgctgctgaagggagcgtttttctattttattattgttgatcttttactatgtctaatttataaattaaactttcatgtatatacaggaaaaaaaacatagtatatatagggttcaccatgagcacggtttcaaggcatccaccaggggtcttggataaggagaaactgctgtagttaatgataagaaaatgcagatgagttgtgaaagatgagatgtaaaattaggctgtgtaatcacaaattgaaaaaaatgtctttataaataggaaaaggtaataatcatgtgtcctttagaataggaagattttagatttttgttctatattttctaaattgctttatactaaatttcttttgttcaaaatatttttcctacgtagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccngaattagaaaaagaaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaatttatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 384865 - DNA, 2163 bp, Homo sapiens
  misc_feature (488)..(488): n is a, c, g, or t
gatttttcttgttaccttaatttctgttttaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccngaattagaaaaagaaagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatatcgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaatttatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 384866 - DNA, 326 bp, Homo sapiens
tggattatgtggttattctaattccaatttttttaaagaactattcataactttttaatcttctccaaaggcaattcttcagttagatagtcctgaatctgctcagtcaatgtatagctttctgaaacaaaatccacaaaatattggtgaccatatgttgacctgctcattatctccaaagatagacttaccagaggtaagatttatctttcttcagcttttgtgattttagaaaatacagagaacataaaggtcattctcaggtagtagtcaaactgtttctgtgtttagagatgatttttataatttgtgttgcaatcagtgtt

SEQ ID NO: 384867 - DNA, 821 bp, Homo sapiens
gttatttcatcacccagatattaagcctaggacccattagttatttttcctgatcctctccttcgtcccatcctccaccttccaataggccccagtgtgttgtttccctctatgggtccatttattttctttagatcatctttaaggtatattttgaaattttgcctaaaaattatcaaagtggggattgctgtcttttgtttttcaaagagagatgtttggcttatgtcaggtcagcctaaggagacttgaaatgtcaaactagcttaagttcctgtttagattcattagtttaattatattagtgttttactagactattaaagcagactatttcatgcagaaaactctgaaataaagaccagtattgaagtcaaagccactgaaaactgtgctaaagaagctatttctggtaggtcaatagaaattttattttgttctttacttattttaattaccaatgccatacctaagtgaaattaagagtattacgattcatgtctttatctcttaatctgaaattttgatctcagaatgaaatttaaatgtattttttaaaagccaatgtcacttttgtagtcattttgtactaattctctagacttgttgtattacacgttttcatgtagctactgtttaacctattgtggaataaagtaggatcttgataagtatgtctgcattgtttttaattttattttgtattaagatgctgctttggaggccacagagaatgaaccacttaacaaggtcagttttcatgttttatttatttctttaaagctcaagacattttaacaaaagatatttttcttataaac

SEQ ID NO: 384868 - DNA, 302 bp, Homo sapiens
gaggtgtttccaaattctgcttgcagaatgtatacatgctttatctttctgctctgggcagcagagatgagaacatgtgttacctagtgaacaggtctgaacttggtgaacctgaacctaatgaagatcaacaatattatttattgctatctcagctcactgcaacctccacctcctgggttcaagtgatcctcccacctcagcctcctgagtagctaggaccactggtgagtgccaccacgctcagctaattttttgtatttttggtagagacagggttgccaaagctggtctcaaactcc

SEQ ID NO: 384869 - DNA, 802 bp, Homo sapiens
ggaataaagtccaaattctttggctttccataaattattctttgccctttgaccccagattatcttttgaacctattaacagtcaactgtgtattattttgtagtcactcagaatagtttattttccatgttacttcattccttggttctttatttatgctgtctatttgcatggaattgatggctgacttcatttaacttcagtaagcacttaataggtcgcaggcaaggtactgaagataaaaagtcagttaagacttcttttggggagagttggaggacagattctgatttatcctgtaaggctcatctctgatgaaacttccttgatcgaatgatttttttctcttgttatggcttttctcttttttagaaataatatgtccccttttctttttaccttttcagttcccagctgaaaatgacattcttttaaatctaagtataaaagtaatgaatgtttattgtgaaaattttaaaatatttcagaaaatgtttaaagaaagtgatttacaccattcagagatcacctcttgtttatttgcttaagtcagttattttcccaataaaagccctttgctcacctgtgggaactcccacatgtgagttccaccaaatctttcagaaagcaatatcgatttcagctataccatggcattcaggagaagggaaagcttcctgtaaaaggggaaatgagaaaaggtgggggaacaggctaatacatcaaatactgacaaagacactacacacctatcagaatggctaaaataaaaaatactgatagcaccaaatgctgatgagt

SEQ ID NO: 384870 - DNA, 6502 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctgccaaaactggacaagccaaggcatctgtagccaaagtaaacaaatctacagggaaatcagcaagttctgtaaaatctgtggtaacggtagctgttaaaggtaataaagcttcaatcaaaacagcaaaatctggtggaaagaagtctctagaagccaaaaagactgggaatgtcaaaaacaaagactctaacaaacctgtgactataccagaaaactctgaaataaagaccagtattgaagtcaaagccactgaaaactgtgctaaagaagctatttctgatgctgctttggaggccacagagaatgaaccacttaacaaggaaacagaagaaatgtgtgtgatgcttgtctctaatttgcctaataaaggatattctgtagaagaagtttatgacttagcaaaaccatttggtggtttaaaggatatcttgattttatcatctcataaaaaggcatatatagaaataaatagaaaagctgctgagtctatggtaaaattttatacctgcttcccagtattgatggatggaaatcaactctcaataagtatggctcctgaaaacatgaatataaaagatgaggaagctatatttataaccttggtaaaagaaaatgacccagaggcaaacatagatacaatttatgatcgatttgtacatcttgataatttaccggaagatggacttcagtgtgtactttgtgttggacttcagtttggaaaagtggatcaccatgtattcataagtaatagaaacaaggcaattcttcagttagatagtcctgaatctgctcagtcaatgtatagctttctgaaacaaaatccacaaaatattggtgaccatatgttgacctgctcattatctccaaagatagacttaccagaggtgcaaattgagcatgacccagaattagaaaaagaaagccctggcttgaaaaacagtccaattgatgaaagtgaggtgcaaacagcaactgatagtccctctgttaaacctaatgagcttgaagaagaaagtactcccagcattcaaacagaaactttggtacagcaggaagagccttgtgaggaagaagctgaaaaagcaacatgtgattctgactttgctgttgaaactttggagcttgaaactcaaggagaggaggtcaaagaagaaattcctcttgtagcatccgcttcagtcagtattgaacaattcactgaaaatgccgaggagtgtgctttaaatcagcagatgtttaacagtgacttggagaagaaaggggcagaaattattaaccctaaaacagcattgttaccatctgacagtgtgtttgcagaagaaaggaacctcaaaggaattctagaagaatctccatctgaagcagaagatttcatttctggaattacacagactatggtagaagctgtagctgaagtagaaaaaaatgaaactgtttcggaaatattgccatcaacttgtattgtgacgttagtaccaggaattcccactggggatgagaagacagtggacaaaaagaatatttctgaaaaaaaaggtaacatggatgaaaaggaggagaaggaatttaatactaaggaaaccagaatggatcttcaaataggaacagagaaggctgaaaagaatgaaggtaggatggatgcagaaaaggtggaaaagatggcagcaatgaaagaaaagcctgcagaaaacactttattcaaggcatacccaaataaaggagtgggtcaggctaataagcctgatgaaactagtaaaactagtattctggctgtatcagatgtatctagcagtaaaccaagcatcaaggctgttatagtctcttctcctaaggcaaaagctacagtttcaaaaactgaaaatcagaaaagttttccaaaatctgtgcccagagatcaaataaatgctgaaaagaaactttcagccaaggaatttggtctgcttaaacccacaagtgccaggtcaggcttggcagaaagcagcagtaaattcaaacctactcagagcagtcttaccagaggaggcagtggaaggatctcagccctgcaaggcaagctttctaaactggattacagagatataacaaaacaatctcaggaaacagaggctagaccttccatcatgaaacgggatgacagcaacaataagactttggctgagcaaaacactaagaatcctaaaagcactactggtagaagttccaaatctaaagaggagccattatttccatttaatttggatgaatttgttactgtggatgaggttatagaagaagtgaatccttctcaggccaagcagaatccactaaagggaaaaaggaaagaaactctcaaaaatgttcctttctctgaacttaacttaaagaagaaaaaggggaaaacttccactcctcgtggtgttgagggagaactatcttttgtgacattggatgagattggggaagaggaagatgcagctgcacatctagcacaagctctagtcactgtggatgaagtaattgatgaagaagaactaaatatggaagaaatggtaaaaaattcaaattcactttttacattagatgaattaattgaccaagatgattgcatttcccacagtgaacctaaagatgttactgttctgtcagtggctgaagaacaagatctcctcaaacaggaacgcttggtaactgtggatgaaattggagaagtggaagagctacctttgaatgagtcagcagacataacttttgccactttaaatactaaaggaaatgaaggagatatcgtaagggattccattggcttcatttcttctcaggtgcccgaagacccttctactttagttactgtagatgaaatacaagatgacagcagtgatttgcatttagtgactttggatgaagtaactgaagaggatgaagactctctggcggattttaacaaccttaaagaagagcttaattttgttactgttgatgaagttggagaggaggaagatggagataatgatttaaaagttgagttagcacaaagcaaaaatgaccatcccacagataaaaaagggaatagaaagaagagagctgtggacacaaaaaagacaaaacttgaatccttgtcccaagtgggtccagtaaatgagaatgttatggaagaagatctaaaaaccatgattgaaagacacttaacagctaaaactccaaccaagagagttagaattgggaaaactctgccatcagaaaaagctgttgtgacagaaccagcaaaaggtgaagaggccttccagatgagtgaagttgatgaggaatctggattaaaggattcagaaccagagcgaaaacgcaagaagactgaagactcttcttcaggcaaatcagtggcgtctgatgtccctgaggaattagactttcttgtacctaaggctggattcttctgtccaatttgttccctcttctactcaggtgaaaaagcaatgacaaatcactgcaagagtacacgtcataagcaaaatactgagaaatttatggccaagcaaagaaaggaaaaggagcagaatgaggctgaagaaagaagctctaggtgattgggggaaaggaaagaattcactagaaatttgtttagggtccagttgatttgtgtatttttgttatcatttaatttgtaattttcgtttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatattt

SEQ ID NO: 384871 - DNA, 2889 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctggctggagttcagttgtggaatctcagttcattgcagtctccacctcccaggttcaagtgcttcttccacctcatcctcctgagtagctggtattacaggccagagacacctcatccagctaaaccttttttttctttatacactaagtataaagaataatagcaataaaacattttaaattacaaaagctga

SEQ ID NO: 384872 - DNA, 2865 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacagtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgagaggatgtcaaggagatcagtgagatcatcagatagaaaaaaagcattagaagatgtagtacaacgatctgggcatgggacagaatttaataaacagaagcatcttgaagctgctgataagggacattcaccagcacaaaagcctaaaactagcagtggaacaaaaccatcagttaaacctacaagcgctacaaagagtgattcaaatctaggaggacattctattcgttgtaaatcaaagaatcttgaagatgacactttgtcagaatgtaaacaggtgtctgataaagctgtttctctccagcgaaagcttcggaaagaacagtcattgcattatggttcggttcttcttataactgaattaccagaggatggttgtactgaagaagatgtgagaaaattatttcaaccatttgggaaagtgaatgatgtcctaattgttccatatagaaaagaggcttacctagaaatggaatttaaagaggcaattactgcaattatgaagtacattgaaacaacacctcttacgataaaaggaaaaagtgtgaaaatatgtgttccaggaaagaaaaaagcacagaacaaagaggtgaagaaaaagactttagagtcaaagaaagtatctgcatctaccttaaaaagagatgcagatgcttcaaaagctgttgaaattgttacttcaacttctgctggactgctccctacaggcgggggcaacaattacccacagattgtgttggctccaggcctttgtcattaaatctgtactaaataaatacaagcagctccagcttattggggctgcgttctctcttcggcgtctctaaggccgagcagtttcctagctgcgctcacgcaaa

SEQ ID NO: 384873 - DNA, 2212 bp, Homo sapiens
aggcgcgcatgcgtgcagctctttggaggcggtagctttttcggcgtcgagactggaggctgagtgctaaactgtgtggggcgcggatgggatccagctgttagtcgggtaggcatagctttgtgttattcttggaaaatttcgcaccacttgtgaattccttgaacctgggcattgcaaacccacttctgttgggcccatctcctttgcactttgctcagattaagactcagttggcgcttcagcagctgaatgccgttgcctcacatggttcaacaccaccttatactttattaaatcaggctttcttgaaaatagccatgtcgagacccaggtttaatcctcgaggagactttccacttcaaaggccacgagcacctaacccttctgggatgaggcctccaggaccatttatgaggcctggatctatgggtctcccaagattttacccagcagggagagcacgtggaattccacacagatttgctggccatgaatcttatcagaacatggggccacagagaatgaatgttcaggtaactcaacacagaactgatccaagattgaccaaagaaaaactggattttcatgaagcacaacagaagaaggggaagcctcatggtagccggtgggatgatgagcctcatatatctgcatcagtggcagtgaaacagagttctgtaacacaggttacagagcagagtcccaaagtacagagccgctatacaaaagagagtgcctcaagtatcttagcaagttttggattatctaatgaagacctagaagaacttagtcgctatcctgatgaacaactaactcctgaaaatatgccattaattttgagggatataagaatgcgaaaaatggggcgccgattacctaatttaccttctcagagcagaaataaagaaacacttggtagtgaagcagtttcaagtaatgtgatcgattatgggcatgcaagcaaatatggctacacagaagatccacttgaagtacgtatttatgatcctgaaattccaactgatgaggtcgagaatgaatttcagtcacagcagaacatttctgcatctgttcccaatccaaatgtgatatgtaattctatgtttcctgttgaagacgtatttcgccaaatggacttccccggtgagtcctccaataatcggtcctttttctcagttgagagtggaaccaagatgtcaggcttacacatttcaggaggacagtcagtccttgaacccataaaatccgtcaaccaatccattaaccaaacagttagccagacaatgagtcaatctctgattcctccatctatgaaccagcaacctttttcgtcggaattaatttcatctgtaagccagcaagagcggatcccacatgaacctgtgattaattcatctaacgtacatgttggatcaagaggaagtaaaaagaattaccagtcacaggctgacattcccattcggtctccctttggtattgtgaaagcatcctggctaccaaagttttcacatgctgatgcccagaagatgaagagacttccaactccttctatgatgaatgattattatgcagcatctccaagaatatttccacatttgtgttctctgtgtaacgtagaatgtagtcatttgaaggattggattcagcatcaaaatacatctactcatattgagagctgtcgacagttacgtcaacactcactgcaacctccacctcctgggttcaagtgatcctcccacctcagcctcctgagtagctaggaccactggtatcctgattggaatcctgagatcctcccatcgagaagaaatgagggcaatagaaaagaaaatgaaactccacgaagacgttctcattcccccagtcctaggcgttctagaagatcaagctcaagtcacagattccgtcggtctcgaagcccaatgcattacatgtataggccgagaagtcgaagtccaagaatttgccatcgtttcatttctagatacagatccagatccagatcccgttcaccatatcgaattagaaatccatttagaggtagtccaaaatgctttcgatcagttagccctgtgggaactcccacatgtgagttccaccaaatctttcagaaagcaatatcgatttcagctataccatggcaacagcaaaggagtgccctaaaagcgtgctgttcactcaattatcgtactctaaaaccccacaccac

SEQ ID NO: 384874 - DNA, 520 bp, Homo sapiens
tccgcgtgcaggactgctccctacaggcgggggcaacaattacccacagattgtgttggctccaggcctttgtcattaaatctgtactaaataaatacaagcagctccagcttattggggctgcgttctctcttcggcgtctctaaggccgagcagtttcctagctgcgctcacgcaaaatacctgtgtctgcgtacttttttcatccgtcgctcggccagagtcggtggatcagactcagcagctggtgcccctcgtgaggaacactgcaagggatcacgacggaacccccgaaaatgaaggcgaagagactgtgcagtcagtaagtcattggtgcccactcgggatatccaagttcaggggaattctcagactagagtttcatcatgagacaacagctgtccgcacaacagaaacagtatataaaagtattgaaacaactgcttaaagctagcagagcctcggtttcacaggctcagttaagggtcctaaggcaaactgttgtttcccataatccatg

SEQ ID NO: 384875 - DNA, 1709 bp, Homo sapiens
ctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccaggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgcttcttgtgtgaccagtggggaaggacagccgacccttggggggaccggggtgcccaccaggcgcccgccggccactgcaaccagccccgtgccgcagagaacatggccaatcagggtcgacgagaagctgggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataaaaaatcaaatatcattgccttcctccaggagtaattaggaacagctgagggcatgctgggagtaagcagcaagagtgcattctgcttttagattgagggagaggtccttaagttcctcgaatgagacacagatctttaagaactagtaactttttcattgattcttttatcctttcttttcaaagtcactgctacttgtgtgctttgctataaatcgaaagtgtagtgttgccagaattgctggctctggaagaaaattacagttgaccaccagttcaagtgtttactttatgtccatgcccaaggaaaacacataatttgcgttttccctttccagtgtttgtgctttccagcgtaatgacctccccaagcaaatagccctctcctgaacatcaagatgctcatcctcatcttcaattatggtgatgttaattctcaattaaaatgttaatgctaagta

SEQ ID NO: 384876 - DNA, 1623 bp, Homo sapiens
ctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccaggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgcttcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgata

SEQ ID NO: 384877 - DNA, 1869 bp, Homo sapiens
ctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccaggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgcttcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctacca

SEQ ID NO: 384878 - DNA, 1968 bp, Homo sapiens
ctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccaggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgcttcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgata

SEQ ID NO: 384879 - DNA, 2429 bp, Homo sapiens
ctcgagcgggacagatccaagttgggagcagctctgcgtgcggggcctcagagaatgaggccggcgttcgccctgtgcctcctctggcaggcgctctggcccgggccgggcggcggcgaacaccccactgccgaccgtgctggctgctcggcctcgggggcctgctacagcctgcaccacgctaccatgaagcggcaggcggccgaggaggcctgcatcctgcgaggtggggcgctcagcaccgtgcgtgcgggcgccgagctgcgcgctgtgctcgcgctcctgcgggcaggcccaggcccggagggggctccaaagacctgctgttctgggtcgcactggagcgcaggcgttcccactgcaccctggagaacgagcctttgcggggtttctcctggctgtcctccgaccccggcggtctcgaaagcgacacgctgcagtgggtggaggagccccaacgctcctgcaccgcgcggagatgcgcggtactccaggccaccggtggggtcgagcccgcaggctggaaggagatgcgatgccacctgcgcgccaacggctacctgtgcaagtaccagtttgaggtcttgtgtcctgcgccgcgccccggggccgcctctaacttgagctatcgcgcgcccttccagctgcacagcgccgctctggacttcagtccacctgggaccgaggtgagtgcgctctgccggggacagctcccgatctcagttacttgcatcgcggacgaaatcggcgctcgctgggacaaactctcgggcgatgtgttgtgtccctgccccgggaggtacctccgtgctggcaaatgcgcagagctccctaactgcctagacgacttgggaggctttgcctgcgaatgtgctacgggcttcgagctggggaaggacggccgcttcttgtgtgaccagtggggaaggacagccgacccttggggggaccggggtgcccaccaggcgcccgccggccactgcaaccagccccgtgccgcagagaacatggccaatcagggtcgacgagaagctgggagagacaccacttgtccctgaacaagacaattcagtaacatctattcctgagattcctcgatggggatcacagagcacgatgtctacccttcaaatgtcccttcaagccgagtcaaaggccactatcaccccatcagggagcgtgatttccaagtttaattctacgacttcctctgccactcctcaggctttcgactcctcctctgccgtggtcttcatatttgtgagcacagcagtagtagtgttggtgatcttgaccatgacagtactggggcttgtcaagctctgctttcacgaaagcccctcttcccagccaaggaaggagtctatgggcccgccgggcctggagagtgatcctgagcccgctgctttgggctccagttctgcacattgcacaaacaatggggtgaaagtcggggactgtgatctgcgggacagagcagagggtgccttgctggcggagtcccctcttggctctagtgatgcatagggaaacaggggacatgggcactcctgtgaacagtttttcacttttgatgaaacggggaaccaagaggaacttacttgtgtaactgacaatttctgcagaaatcccccttcctctaaattccctttactccactgaggagctaaatcagaactgcacactccttccctgatgatagaggaagtggaagtgcctttaggatggtgatactgggggaccgggtagtgctggggagagatattttcttatgtttattcggagaatttggagaagtgattgaacttttcaagacattggaaacaaatagaacacaatataatttacattaaaaaataatttctaccaaaatggaaaggaaatgttctatgttgttcaggctaggagtatattggttcgaaatcccagggaaaaaaataaaaataaaaaattaaaggattgttgataaaaaatcaaatatcattgccttcctccaggagtaattaggaacagctgagggcatgctgggagtaagcagcaagagtgcattctgcttttagattgagggagaggtccttaagttcctcgaatgagacacagatctttaagaactagtaactttttcattgattcttttatcctttcttttcaaagtcactgctacttgtgtgctttgctataaatcgaaagtgtagtgttgccagaattgctggctctggaagaaaattacagttgaccaccagttcaagtgtttactttatgtccatgcccaaggaaaacacataatttgcgttttccctttccagtgtttgtgctttccagcgtaatgacctccccaagcaaatagccctctcctgaacatcaagatgctcatcctcatcttcaattatggtgatgttaattctcaattaaaatgttaatgctaagta

SEQ ID NO: 384880 - DNA, 282 bp, Homo sapiens
attacccagttcaggtccccggttccccacctggtagctgttcgtccttaagcatgatacttttccttgaagcatcagcttcagcaacatttaaataagactaataatgatacatatttcatagggttcatgtgaaaattaaatgacacttaaaaaaaatgaagtgcttagcaaaataccaaacatataacaaatattcacggaatgccgactgttagtgcttatggtccaactaaaggattctttgatttaattaactgttatgaaggtctctttataact

SEQ ID NO: 384881 - DNA, 245 bp, Homo sapiens
gtataccatttaacagataatgcaagcaattagaaagataatagtttgctgtgcctccttctttagtctaactcttgactactataacctttatgaagtcatttgacttgtttcttaatggtagtcaccagaacatatgggtgagtgtgagaatgtataaataaatgctaataatatacagttaaaagcctatagaagtggaaaatgggcccaacttgtcactggtgagctttaatccagcctaa

SEQ ID NO: 384882 - DNA, 657 bp, Homo sapiens
cacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctccctatcccacccccatgaccccaagcaatgaaggatttagggcagatttaccttcagtaaacacctttggacaccttgcggggaaagtgggagtctgtttgcaaaaggaggcttttgttaagtgaggtacggggataatgctttacccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaa

SEQ ID NO: 384883 - DNA, 407 bp, Homo sapiens
gaatgaattgggggataaagggattagattccaggagtaatgagttagatgcaaaggtaaagaaattagttgataatgattgggaactcaaagacaatgtaactgtctagttagagtggtgggtctttttgctagaaatctgaagttctgtttcacacctgagcccagccacccaagcagaaatcctaactgcctggagcagtatagtgcttctatattctgttgcagtctctatgaaagctccggtaccaaaggagtccagctgactcatatcaagtgataagaaattcatctttgcaaaactggaagcaactcaaatgaaaatgattgcagtacattcactggagtgaatagataattaagactatataactccgtggaaccaggtttttcttctcatttaggtt

SEQ ID NO: 384884 - DNA, 316 bp, Homo sapiens
gtttaacaagcctgctaaatactaagtcaatgtaaaaaatcaattgtaagcccatctatcagaaaaacactattagcaagcaaaatttacatttttactgcttaacatagcatcccaaatatcaagtacctagcaacaaatctaacgaaagatatgcaagacttatagagaaaacagcaacagcaacaactttgtttagatacattagcgaagatctcattacatggagacatacactatgctcatggactggaagactccatatggaagatgccaattcacatctcagaatctcagcaggtgttgcaaagaacct

SEQ ID NO: 384885 - DNA, 907 bp, Homo sapiens
tgttctgtttgattgatttattgggcttctctttttatatccagtaggggaatcagattgtggccaaaggtagtgtattaactctagaaaaggagattatatctacagttcctcaaacaattttagatttttcttttcaaggacagctagagaagataatgacataataactatttccttttttaggatctgaatctaaaaatggtgaagcagacagttcagataaagaaatgaaacatgggcaaaaatctcccactggaaaacaaacaagtcagcacttaaaacgattaaaaaagtctggtttaggtgagtgtttaatagactatgccatttcacattttagaaatttgtgttttctcaaataaattatctaaaattttcagaacattttttaatgattaaacaaggaaattaaaatttccctccatttatcaaaaccaaaaagaatgctaaataaggaaacattctagttacaactgaatggtcttaagcccattactaaatttgtgaatgataatattggatgaagcagagggtaaaaatgagacttaaaatggtacatgtaaaataattatctgccgggtcatgatactatctaatgtgcagtgttttgtctgtgcaactaggtttcactttattggaatatgctgtcttggaagaaaaaaatgcagtctttataaagggttcactgaactggagagtacattgtcagtggggtctgctgcagtaaaattgctcttccttgctttttgtctatgcttcttaaaatatttagtagtgcctgtctgaaaaaatgtaaaattgctgagaaatgttggagacacaggccacgggtctttcaaatcagcaccaggttttcttcaacatacttctttcctgataacttttcatcaggaacccccaacag

SEQ ID NO: 384886 - DNA, 633 bp, Homo sapiens
tgttctgtttgattgatttattgggcttctctttttatatccagtaggggaatcagattgtggccaaaggtagtgtattaactctagaaaaggagattatatctacagttcctcaaacaattttagatttttcttttcaaggacagctagagaagataatgacataataactatttccttttttaggatctgaatctaaaaatggtgaagcagacagttcagataaagaaatgaaacatgggcaaaaatctcccactggaaaacaaacaagtcagcacttaaaacgattaaaaaagtctggtttagggcacttgaaatggaccaaagctgaggacattgacatagaaaccccaggatctattcttgtcaacactaacttgagggcattaataaataaacatacgtttgcttccttacctcagcattttcaacaatacctcctgcttttgctcccagaagtggataggcagatgggaagtgatggaattttacgcctcagtacttcagctctaaataatgaattctttgcatatgcagcacaagggtggaaacagcgactggcagaaggtaaatttgtattttctattattatgtgacatattggagtacacataccgtactgagcttgtacct

SEQ ID NO: 384887 - DNA, 302 bp, Homo sapiens
tttttttttaatgctgttgccatggtatatctttatcatttgctttcaacaaatctttctacttaaagtgcatacgtcatagacaacatggaactcggtcttgctatttagctggtctgatcatttctggctaattcagatattcagtctatgtatatttaatttaattgttggttttattaggttcaaatgtaccatcttgggatttgttttctatttgttgaatctgtttttgctcctcttgtcctgcttccctgtggttttatcaaatgtacttttactattcaatatttttgtctact

SEQ ID NO: 384888 - DNA, 646 bp, Homo sapiens
aaaacctgtaataacagtgtggcaaacctatagcagaccatgaataagctgtagccattgttgttgacaatggatgggacaaggtcctcatgatgtggaaaggaatgtctagagcccgttagaggctcttcctaggaaaggtggggaacgagttttccgctgagtagggcaggagcaagggaaggactgatgtgatgcaagggaggctggcgaccttgagcagactctccttccagtctcatccccaaatctaacttgctgccacataatcagtcattgatctcatggtgctgggaaaagagtggcaaagtggaagaataaaaaccttccaggaattagtctctttttactctcttttttcatattgcttctgttctttagaaaaattcaaaataaaaagtcgaaattcacatctggggcttcacacagtagatgcaaatccactctgctgaggacagcatatgcctatgtgttttgctgaaatttcagtcgttcccgtggctgtttcagcacttgagctggttctcagaagatcctgctgtggagcagtgtgctgttaaccaccagcagcacggtctttgcctcagactccttggtcagcaaagtagagcaaaggtaatgtgatctggtgaataagaaacagctc

SEQ ID NO: 384889 - DNA, 430 bp, Homo sapiens
gggttgtgatggagaagactgagacggggcaatctaaggcccaaacgtggcccagtgttaagcatattgagaaacccaataccaatctggtgaattgaatagttttgcaaaactaaggaaaattaacagtctccacaaaaaagtgtttatccaagtgttaaagtacttaattgttctcaaaaaaccaaattgtccccattctgaacatttttttgaactttctcaattgcagttagtcttctgggacattgaagaaggcctagaactcaatcaaggaacaaaaatatctaagcattgtatttaaaaaacatgtgttagaggtttattaccttaggagatttttaaatatcatttatctgttaaatttagttgttgcatcagacattttgctcatttttccctttaataattatatctttataccactaac

SEQ ID NO: 384890 - DNA, 281 bp, Homo sapiens
ataattcatgatagaatatcactatgtgctttggaagacactgaggaaagacaaaaggtcattgggcagaaccaccctagattgaatgttaaggccatcttctagtttgcaggacttgtggtagacagacagaataatatcctggacctcttgggtgtatacaggacaaactgaaataaactctcatttttagatcataatgtcatcatgaaacatatcaatttggtctatttctgaagaaaacaagcacaatgataaagtttgaatgtttgtctcctcca

SEQ ID NO: 384891 - DNA, 337 bp, Homo sapiens
tgggccagcactcaatgtgaatcaggctaacattgacgataacagagtagtctgtgcctgcctgtgcctggacactaattggaaaaacccaacagctacctccttggtgatctctgcccatttgggcaagttccaaagagccagctccactcaaagtaacttctctcttttttttttctgtaacccagtgcctgaaaaccaggaggaaatcatttccctgatttctgtttagccttctaaaatcatggcagtagttgtcttatattcaagggccactgacattgggggtttttggtttctaagtcatttcctatctctgtttcactcttaccttttc

SEQ ID NO: 384892 - DNA, 167 bp, Homo sapiens
ctgactactagctgtttcttttctattatctaacagagtttatgttagtctttttgacgagtattcattatttttaacatgcatatttagggaatcataataattttagaagatactgttttaagttatggacattaaagccataggtaaaagaatatgaaggtaaa

SEQ ID NO: 384893 - DNA, 664 bp, Homo sapiens
cgcctgtaatctcagtactttgggaggccgaggcaggtggatcacctgaggtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaactccatctcaaaaaataaaaacaaaaaacaaaaaaaaaatgtgatatcataagacagaccttttcccttctcatcagtgactggaattaactgcccatgtggaatgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaattggcttgaaaaaaatgta

SEQ ID NO: 384894 - DNA, 219 bp, Homo sapiens
aagaacttgagattgatttcgtattctgcagttttccaaagaagctgcttacagataactgcggaagggttgatcttatttagataggctactagacctcagaagctagacttttgtttttcaaatagtggctgtggattctatatcctatgtccaagctaccgtttgggacaacatggttcccttcaggtggttgcaagtacgtgagaggctgatctt

SEQ ID NO: 384895 - DNA, 791 bp, Homo sapiens
ctcattttattgcgatatgcactttatggtggggttctggaaccaaacctgaaatatctctgaggtatgcctgtatttgttttcccctgctgtacaaaagtacaaaactatgtttaagtagcatgtttaattcttgatgccattattaccacataacatctttatatttttatacaaaacacctcgccgtgagagtttcttaaggctgtgcttagtgttaactggaagccaatgctaatactgaaaaaaaaaaaaagggtgggggaattggatttgggatcaggatgtagataggcttcccaggatttcaggaaaaaaattcagaacaggaaagagcatcttgaagatataccataaaaagatggtctttttgagtggtatagtcagtttctaatttaagagtaatttctctctcagatgtgttaaagtgtaaaaaaaaatctaataagatttaacacttcaaagtcattaactaactaattaactaatgaatccacacaacagctctatgaggtttatgctaaatatctatcatttcacagatcttgtgtcatttagaaactcttctagcttttctcgtctctgctcttttcaaagtctttaaaaagaacgaattattttcatgtctccagtgaaggacatgtatcaaatttgtctcttgagaaaatccaatgctttgtgaagtaaatttccaaagccagtcaattaactcagtgcttttcctattaatgtgactccaaatttctgatatcccttgccctgagaagctattttgtttgccctgggaagaa

SEQ ID NO: 384896 - DNA, 584 bp, Homo sapiens
ggttttcttagttttgaactttttcttccttaccgttgtcttccacctcatttcctggaaagggaaatcgtttccttctcatgatctgcgaggcttccttccctcctctctcttgtcgttgtttcattttgttttcgtcttttggccccaaggaagcagacgaagaatcctggagtgagagagacccgggttcccattccaactttcccctcacttgctgtgagactttggcaagttcgttggcttgtctgagcctcagttttcctccttgtaaaatggatataaaaatctctgcaccactgagttgcagcagtattaatgtcatactttatacagcatgcctagtgcctgccccagtgcagatgctcaggaaatatcgtccttacttaggagcactcctgtcaatgaaaacaggacctcttgccaaagagaaatattttgtgattagtgcttgctcctgtccctgcccccatgagcaagtgtcctccctttctcctcctgcattgttgaggacacgtttcttgatacaaatttaactacagccactaaatcagaaattcccacccaaagtcataccataagca

SEQ ID NO: 384897 - DNA, 243 bp, Homo sapiens
ccgcctcggcctcccaaagtgctgggaataataattttaaataatctgtaatgtatgtaaaaattctgccatggaaaatattcttcactgaaactcaagcttccaaaggtaaagaattcatgtttgttttacaaatgtcagttattaatatagtacaatgcctcatacgcaaaacttttagttttattttttaatttctcctcaaaatgtgctagtaggcaaatttaaagaaaattatatata

SEQ ID NO: 384898 - DNA, 343 bp, Homo sapiens
gcaacctcatcccaggttcaagtgattctcctgcctcagcctcctgagtagctgggattactggcgcaccaccacacccggctaattttgtatttttagtagagacagggtttcgccatgttggccaggctggtcttgaactcctgacctcaggtgatccacccacctcagcctcccaaagtgctgggattccaggcatgagctactgtctcggcccaaatctttcttaagttgtgtctggcctttggcagaaatagccacaaagccagggtaggaacgttttactcttcaagtgatgatggcatccgataaccttttagagggaggttttaaaatgcaacgt

SEQ ID NO: 384899 - DNA, 1622 bp, Homo sapiens
cggacgcgtgggtcgcccacgcgtcggcaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgc

SEQ ID NO: 384900 - DNA, 2160 bp, Homo sapiens
cctgggtgaccgagcgagactccgtctcaaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgc

SEQ ID NO: 384901 - DNA, 2069 bp, Homo sapiens
cggacgcgtgggtcgcccacgcgtcggtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgc

SEQ ID NO: 384902 - DNA, 1623 bp, Homo sapiens
  misc_feature (14)..(14): n is a, c, g, or t
tctcgagtatcccntccccgtacgcccacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtgggaggtgggggggaagctgtgcccacctttaaagagggggccattgctcagccatgcagaaaaaaatggggcaacaagctggaaatcaggttttttttttttaaagtgaaacttgatgatttttaaacaagtaattaaaaaaatgtccaaaacaccatgtgggccaaacatttgtttgagcctgggggccaccagtttgcgaccactgccttacgtagttaacaccctgagtatgtatacagtcatattttttgttttggatatggtagtgttatatatacttgggggcgtgatatttgaagtcatctttatctctcagagttaagctttattgtagaagaaaaaaaaaaaagttaacacagccatagataacacttaactcacagttcccaggaggacacttgatctcgaagctgctctttttgagtcagatcctacatcaaaccacttagggccagtttttggcatttccttcctggtgatttggggtaaacttctttgctctgtcggagtttgcagatgagtaatcagaaggattgcagaataacttgtttctttgtattttattcttacatttaaattaattttggggggttagtggtatcctagctcgtgcctttacagggatgattggtggctagatttggggtgcaagcttcttaggctcataccatttcaactaccaagaacacaggtttttgtttttgttttttgagacagggtctcagtctgttgcccaggctggagtgcagtggcaagattgcagctcattgcagccttgacctcctgggctcaagcgatcctcctgcctcggcctcccaactagctgggaccacaggtatgtgccactacacccagcgaatttttaaattatttgtagagtcagggtctccctatgttgcccaggctggtcttgaactactggactcaagccatcctcccacctcggcctcccaaagtgttgggattataggcgcgagccaccacacctggcctaaaagcgtcgttctgatcagacttcacccctgaatgtttctatcattttcttttctttttttttttttttcgagacagagttttgctcttgttttacaggctggggtgcggtgggatgatcttggctcactgcaatctcctcctcccaggttcaagtgattcttgggccttagcctcccgagtagctgggattacaggcacctgccaccacgc

SEQ ID NO: 384903 - DNA, 941 bp, Homo sapiens
cctgggtgaccgagcgagactccgtctcaaaaaaaaaaaaaaaaaagctttaaaaagctgaattttagaaatatttctagcagtgtcagtgagttcctcttttaatagtgttttaaagtataaatctggtaacatactgttcttgtagttttttgttagttttgtttttcaggttaattacccaaagcctcatccatcctcaaggtttttaaattttatttttttaaaataaattgtgcattgtatttgtgaatttttaaaatattactgttttatttaaatgccatgctgagcaattgttctctgtacatggtaaccaaaacttagagatttcgatcaattttgatcaatgtttagtaaaccaaaacatgtactgtgtacaacggaaataatatggcatattagccaggcatgatggttgcccaagacagttaaattaagctcaattctgtattttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaacccaaacctctctcacaccactcgaacgca

SEQ ID NO: 384904 - DNA, 190 bp, Homo sapiens
atgttggaattcgagatttcctgtgtgcagataattgcatgattctaataaaaataatgtacaggcttgttttagtcattataccaatgccctgcttcactctgctctgctgtaatgagggttcagagcttaattcatatagaaggctagctgcctttctgctaaatggcttgttttgcatttcttttgt

SEQ ID NO: 384905 - DNA, 324 bp, Homo sapiens
caggcctctctgattcccagtgaagaacttggggagtgaaatggacatggagttccatgaccttgatgaattttccttgcttgcctcagtttcctttctctgaagacctgagttccctttcatcttggctgttgtgtgctccacctcagtgaggctggctccctggccctgtcctcccactccagcaagactctgctctcccaccccaacaagactgctgactcctccctcagcagaggggagactttgccttgaggagggttggttaaagtaggaaagtgccccagagtcatgggcgtgggcaggcactgaggtatttgtggc

SEQ ID NO: 384906 - DNA, 2053 bp, Homo sapiens
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggtggcaccaacagaaggtttctgcaaggctgagagctccttttacccatggaccaggagcaaagtttgcaggctgtgtgcggtggctcatgcctgtaaacccagcactttgggaggccgaggtggactgatcacctgaggtcaggagttcaagaccagcctggacaacatagcaagaaccatcttaaaaaagaaaagagaagaatatttaaaattttcttcactgatcattcaggagcatattgtttaatttctgtgtatttgtacaatttcaaaagttcacctcgctgttgagttctagttttattccactgtggtcaggaaagatactcgatataatttcaattattttaaatttgttgagacttgttttgtgggctaacatatggtctattctggaaaatgtttcttgtgctgatgaaataatgtgttttctgaatctgttggatgaaatgttctgtaaatgtctctttgttagtctaaaatgcagggttttttgtttttttgagagagtctcactctgttgcccaggctgggagtgcagtagcatgatcttgactcactgcaacctccacttcccaggttcaagcaattctcgtgcctcagcctgccaagtagctgggattacaggtgcccgccaccacacccagctaatttttgtatttttagtagagacagggttttaccatgttgaccaggctggttttaaactcctggcctcaagtgatccgcccacctcagcctcccaacgtactaggataacagatgtgaaccaccgcgctcagcctaaagtgcagtttaaatctagtgttttgttgttgattttctgtctagatgatctgttcagtgcagagaatggggtgttgaattccccagctattgtattggtgtctatgtctccctttagatctaataatatttgctttatattatgtatctgggcgctccagtgttgggtgcatatatatttagaattgttacctcctcttactgaattgatccctttatcattatataataacctttttcttttttttaatcgttttttacttgacgtctgtttcatctgatacaagtacagctaccctgcttgcttttggtttctgtttgcatggaatatctttttccaccctttcagtctatgtgtgtcgttacagatgaagtgagtttcttgtaggcaaccgtag

SEQ ID NO: 384907 - DNA, 807 bp, Homo sapiens
  misc_feature (671)..(672): n is a, c, g, or t
atttttttttgagacaaagtctcactctgttgcccaagctggagtgcagtgacacgattttggctcactgcaacctccgcctcccaggttcaacctcctgagtagctgggattacaggcgcgcaccaccacacctggctaatttttttttttttttattttttttttttttgagacggagtctcgctctgtcgcccaggctggagttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384908 - DNA, 2572 bp, Homo sapiens
  misc_feature (2436)..(2437): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaatagccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384909 - DNA, 2568 bp, Homo sapiens
  misc_feature (2432)..(2433): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384910 - DNA, 1592 bp, Homo sapiens
  misc_feature (1456)..(1457): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaaccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384911 - DNA, 1616 bp, Homo sapiens
  misc_feature (1480)..(1481): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384912 - DNA, 1502 bp, Homo sapiens
  misc_feature (1366)..(1367): n is a, c, g, or t
agtactctacaggatcttaaacggagctggactgatcagaatggctgatgcagtcatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384913 - DNA, 641 bp, Homo sapiens
  misc_feature (505)..(506): n is a, c, g, or t
cagtccgctttttttaaaagtttaggcccaatttttcaggtaaggctgagttaaaacaagacataggcccccccctttgcccgcgtgaaaaaaggggttttagaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384914 - DNA, 2626 bp, Homo sapiens
  misc_feature (2490)..(2491): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384915 - DNA, 2439 bp, Homo sapiens
  misc_feature (2303)..(2304): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384916 - DNA, 2697 bp, Homo sapiens
  misc_feature (2561)..(2562): n is a, c, g, or t
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggtggcaccaacagaaggtttctgcaaggctgagagctccttttacccatggaccaggagcaaagtttgcaggagaagttgccccagtgcaaggcactgcattcgacctgagaaagccagtggagcttggaaaacacctgcaggacttccatctcaatggttttgaccacaatttctgtctgaagggatctaaagaaaagcatttttgtgcaagggtgcatcatgctgcaagcgggcgggtactagaagtatacaccacccagcccggggtccagttttacacgggcaacttcctggatggcacattaaagggcaagaatggagctgtctatcccaagcactccggtttctgcctggagactcagaactggcctgatgcagtcaatcagccccgcttccctcctgtgctgctgaggcctggtgaggagtatgaccacaccacctggttcaagttttctgtggcttaaggaagtgtgaagatatgatccagtccagggctaggctcagccacctgtctcctgtccagaaaaaaggtgaagattaagaagctttcagaatgattctatggattaaaatcatacaaatggtggctgttctgagaatcagtctgggtattgatttccttttccagtgactggctccaggccatgtctaatgaccagctcgattccctgtgcagttcagagggcaagtgaacccaaccaacaatgtcgtcatctaagccctgaccctagccagggactcccatgctgctgttggctccatctctccacactgcctctttcttttcaactttttgcccttcctttctttaaagctattctcacattgcttttatttcctcctccttcacctccaaccactgtcagcagcactctggagttttcaaatgtcacattagcctcaccctgcatgctaggagatggacctgtctctatacagcagtagatgattgataagtgaggaaactgaggcttacagaggttgaagaccaacaagctaataaataaaaagttgaggccgggcacggtggctcacgcctgtaatcccagcactttggaaggccgaggcaggcggatcacgaggtcaggagatcgagaccatcctggctaacacggtgaaaccccgtctctacataaaaaattagctgggtgtggtagcacgcacccgtagttccagctacttgggaggctgaagcaggagaatcgcttgaacctgggaggtggaggttgcagtgagccgagatcatgccactgcactgggcaacagagcaaaactcgatctcaaaaaaaaaaaaaaaaaaaaaaggaaaaaaaagcagctctctctctcgggagagggaggggacttccgagaggaaaaggcctgcaagagcctttgggttaactgagaaagcacagcccggccaacgcttgggaagaaagacaggcaagcactggaaacaggagctattagggtgaggagagagccttgcctttcacagcacagtgaggatgacattgcaccagggacagagattgtatgtgacaaggctggggctccttctttcctagacaatcaaagtatcagtgatgggttttggttggtgattttgaaaaaaaaaaaaaaaagtatgttatactagtgtatgctgtactgaattgaaataaaaccaaaatctgcatcttttaaaaaaaaaaaaaaaaaaaaaaaaannccctggtgggccgccttggccaatgcgattttgattgaacaagcttttgatgcggcccgcattgagcttacttggcaattgccttataggggggggtttaaattaattgggcgggttttaacaaaggggaaatgg

SEQ ID NO: 384917 - DNA, 1177 bp, Homo sapiens
tacaagtgtggctgcaaagtttgcccctcttgttaccctcaggcaaatgattgatttagaaaggccccaggggctattttttgcaggaacggtcactccctaaatccaggcagggaaagggaggagtctgagccgagtcacgccccttctcctgtaaactttgggtcgcctctagcttagcgagcgctggagtttgaagagcgggcagtggctgcacacgccaaactttccctatggcttcggtgaccagggccgtgtttggagagctgccctcgggaggagggacagtggagaagttccagctgcagtcagacctcttgagagtggacatcatctcctggggctgcacgatcacagccctagaggtcaaagacaggcaggggagagcctcggacgtggtgcttggcttcgccgagttggaaggatacctccaaaagcagccatactttggagcagttattgggagggtggccaaccgaatcgccaaaggaaccttcaaggtggatgggaaggagtatcacctggccattaacaaggaacccaacagtctgcatggaggagtcagagggtttgataaagtgctctggacccctcgggtgctgtcaaatggcgtccagttctcgcgcatcagtccagatggtgaagaaggctaccccggagagttaaaagtctgggtgacatacaccctggatggcggagagctcatagtcaactacagagcacaagccagtcaggccacaccagtcaacctgaccaaccattcttacttcaacctggcaggccaggcttccccaaatataaatgaccatgaagtcaccatagaagcggatacttatttgcctgtggatgaaaccctgattcctacaggagaagttgccccagtgcaaggcactgcattcgacctgagaaagccagtggagcttggaaaacacctgcaggacttccatctcaatggttttgaccacaatttctgtctgaagggatctaatacaccacccagcccggggtccagttttacacgggcaacttcctggatggcacattaaagggcaagaatggagctgtctatcccaagcactccggtttctgcctggagactcagaactggcctgatgcagtcaatcaggcccgcttccttctgtgctgctgaggcccttggaggtgaaggtgcagtgaa

SEQ ID NO: 384918 - DNA, 536 bp, Homo sapiens
ggaccttattcaaggggagaggagtctggagggaatgccgcttggcttcactaccaaaggttttatgacttagcattttaaaaggttttccttttaccaagaaatgcagaaaccaagagcaaaccccacgtaccagatcactgattcctactgaagcagctagcccgagaaaggactctctcatactggtcttgggaaatgacttggcagcctgagccatcccagcagtggacaaggatggttaattcttattctgtagacgtccacaggaacagactaggatggaaaacacagttaagcacagccatgcaccctgtggctgtagaaatgcccctgtgtgaaagaaaaataaattcaagactggagttttggaggaaaaaaaatacaagtagcatttacaacagctctttgctctttaaatttcttaccattcaataaagtgatccagtcactcacatttgaactgagatgccttctccagactgttctgacaaggtaatgaaaataaaatgcacttggatttttccagacatcca

SEQ ID NO: 384919 - DNA, 400 bp, Homo sapiens
ggaccttattcaaggggagaggagtctggagggaatgccgcttggcttcactaccaaaggttttatgacttagcattttaaaaggttttccttttaccaagaaatgcagaaaccaagagcaaaccccacgtaccagatcactgattcctactgaagcagctagcccgagaaaggactctctcatactggtcttgggaaatgacttggcagcctgagccatcccagcagtggacaaggatggttaattcttattctgtagacgtccacaggaacagactaggatggaaaacacagttaagcacagccatgcaccctgtggctgtagaaatgcccctgtgtgaaagaaaaataaattcaagactggagttttggaggaaaaaaaatacaagtagcatttaca

SEQ ID NO: 384920 - DNA, 522 bp, Homo sapiens
aagggttggggagactgtcccgtgcattgtaggatattcagcagcagccctggcctttacccactagatgtcagtagcagcccccatttgtgaaaaccaaaaaattttctcaagatgttgctaattgtcccctgcggtgcagaatcgctcctggttgagaaccgtctctattggatatcaagtcttagtgtagagcaacagtaattaaaagtgtgatattgagacaatgagaaacaattagatcagtggaacagaatagaaaaaaccagaagcagatcctcacatgcatagacaatgattctatcatatttattacagtggactatccatatgttaaataagtttaacttctcaacaccacacgcaaaagtcagttttggtggatttttgacacaaatgtgagtggcaatatgataaaactttagaaaaaaatgtaagagcttatcttcatgctcttgatagcatggaatgatccgttaaagagacacaagaaacactaatatgaaagaaacgctaataagg

SEQ ID NO: 384921 - DNA, 325 bp, Homo sapiens
tcacagtaaccctaggaaagagtaaaccttaatagttacaatagcacaccccgtcacgtaaccctagggaagagtaaacctcaatagttaaaacagcacaccccgtcacagtagccctaggaaagagtaaacctcaatagttacaacagcacaccctgtcacggtaaccttaggaaagagtaatctcagtagtacaacagctacaacacgccctgtcacggtaactctaggaaagagtaaaccttaatagttacaatagcacacagttgtcacagtgaccctaggaaggactggccaggccagggctgtgtacagttgggtcttg

SEQ ID NO: 384922 - DNA, 124 bp, Homo sapiens
aaaaaaaaaaaaaatgtaaatctttcaagaaaaatctagtaggctgcatgtaaaatctaggagttgaggtcactatcttaatcaaaacttaattagctcaaaagctgtaggagacagatggatt

SEQ ID NO: 384923 - DNA, 288 bp, Homo sapiens
aagctaaaaatccagacagagacaagcaggccagcactgaaagaagaatggaattacttaaccccagctcataaacatccaagcagaactctactatgatggatgcaggtgacatgtccagccttgctcagctggccagttgactatagtttttcctcggactttgctgagattttaataaggggcagttgcgagaggaagaaggaaaagatggaggtagaggagacaaaggaaaaagagatggcatgggatagaaagagggcagcagaaagaagtaggcaggcaaag

SEQ ID NO: 384924 - DNA, 4089 bp, Homo sapiens
caggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaccgggcggggtgacaggagagagcgtcagcggcaagctgtggaggatggggctcagaatgcagacctgggctggccgcatggcctctccctgagccctgatttgtggtagggaagcagtatgggtgcagtcccctcctaggcctccctctggggtcccccgatcctatcccacctcttcagggtgagccagcctcacctcttcctagtcctgagggtgagggcaggctgaggcaacgagtgggaggttcaaacaagagtgggctggagccaagggaaaatagagatgatgtaatttctttccggaattc

SEQ ID NO: 384925 - DNA, 288 bp, Homo sapiens
agttacaacagcttccacctcctgacacagcaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggaggtaagtttgccgttagattatggactgttgtttctactgtgatact

SEQ ID NO: 384926 - DNA, 11516 bp, Homo sapiens
caggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgac

SEQ ID NO: 384927 - DNA, 11464 bp, Homo sapiens
caggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacatacacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgac

SEQ ID NO: 384928 - DNA, 11644 bp, Homo sapiens
caggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgacgactgaaaacatttactccctaaaatcacaccaaaacccccaggtgcgcatataaagagaattttaaacggagggcctgttgtctggctcaaatggaggcttgaggggggggccggcccccaatgccc

SEQ ID NO: 384929 - DNA, 11291 bp, Homo sapiens
caggcaccttttttgatccagtcaaggaagaggatttgttgttttcgaaatcagagtgaaggaagcaccgaagcgaaacttaaggaatcctgccttcccggagccgcgggcgatgcgactagggctgccgggcgccgccgccgcccgtccggcttcgtccttcccggcagtcgggaactagttctgaccctcgccccccgaccccggatcgaatccccgccctccgcaccctggatatgttttctcccagacctggatatttttttgatatcgtgaaactacgagggaaataatttgggggatttcttcttggctccctgctttccccacagacatgccttccgtttggagggccgcggcaccccgtccgaggcgaaggaacccccccagccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcactttt

SEQ ID NO: 384930 - DNA, 9799 bp, Homo sapiens
gaattccggtgatgatgatggtgatggtgatgatggtgatgaggatgatggtgatgatgatgatggtgttggtgatggtttttgcatcttccattcatgaactaagtactcttattagtgaatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgtaggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgac

SEQ ID NO: 384931 - DNA, 9672 bp, Homo sapiens
gtctagaggatcccggcatgtggtcataccagggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaatgggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaaaaataaaaaaaaaactgctttatcctcctgtcagcaccccctcccacccctgcaacaaagacttgctttaaatagatttcagctatgcagaaaaatttagcttatgcttccatatttttaaattttgttttttaagttttgcacttttgtttagtctcgctaaagttatatttgtctgttatgaccacagagttatatgtgtgtgtatcaaaagtggtctcaaaatatttttttaagaaaaaaagcaaaaacaatgtattgctgataatcagtttggaccagtttcttaaggtcattaaaacagaagcaaattaagacaggtttgactgcagtggtgtctggtatccatgttttatttctgggcacaagctagtttttatgttgatacgttcctgaacatattatcttgttggacatcttttctcttgtgttttgtttgaatgtgcaatagtttataggccacaaataagctttcttgtaagctctcttcctaacagggcacatattcttccataatataaacacttttctgccccatctcccatacttttgaaggtcagttctatgacagtgaattttgcacaggagaagcagctacctgatttcttactttctctctccttatcatggagaatacagaaacattgtctgaaagggctctaaagaaggaactaccaaaacctgacttgaaatgccatttcttttaaccttccaaatcctaaatgtttccttcaaggcatcttaataaacttatttgcttctggttttgggagttcataagagagaatagaacaaaatacaggacatcaaatattagccatttcccattttattttatttttctatgtaggttcatgttccatgttcatttatttaagaaatacatttttattggtaagcttatagagctacacttatggaatttttaagtaggtaaataaatggttaagacaaaatagtgttatagccttcattctctgaataggccatctttgactcataaaattacccttactgtttattataacttcagaagtaatttatagttctgaacctatagtatcttttaccctgttcccaagcaaagactggtgactttatctgaaaatgattcctcttcccatgacctaaaacactgtgaggaaaaatcattcaagtggcatgccaagtccctatgaaggaagggctgctatcaaacctaccttttttgagcaaactgagactaaacttctctcttttcaaaattgtgttatcttccttaatcctattttcataatttttccttttgccagtttttcacattatctttgatatgtgagcaacatttattatttacattagagtataccttttagtaataaaatgacttgaaatcatattatttttaaaagccctttgcttctttcattacttataatctcctctaaaacaacctctgcatgttttttttaaataaagcactttctgtcaaataatggacttttttctaaacagaaattattttctattaatttgcaaactgatgatttcacttttttttacttttttttcgattatcagagtacttagtaaatgttatatagtttagttctaagatagttccagggattaaaaggttaagaggaaaacacaaatcaccaaatttctgatttatgtttttatctcctgaacaatattttctcactcatattcctctatcttatcacttagctaaagacagcctaaatttcccaattttctgtccaaaatatttgtgatttacttgtatataagccttctcatttgccatgtgctgtgatcttacaagttagatgttactatacctaccatttattcagctggattgctgaacacagttctggattcatagaattaagaatatcttgttagtgcccaggatttccacgtttgtgttttattggcccttttctttattcagccccttaatctattttcagtcttctggcacgtaatttttttcacagttattattcttctattaacaaattatttttatcttgcctagtacattttcacttagttctcttgcccttaaatatctttcacatgcattttaggatattcttttcaaatatttgtaggacaactttgaatcaaaataaattatgttccttctccaatttgaagcattgaggataaatgaccatttgaggtctaactgatcttttcctgccagaagagttatcttacgttctgctatatttgtatttgggccagttgattgtaggttgtccaacattttttaatattgggaaaattatgataaaatgctttaaaaattaatatgccagattaaaataactgaatagtttactatttcattcaagcatgtttaaaacaaataatttcctttcaccagtttttcttagtaaactcctgaaaaagtaggaaaggtggaaagtatatatcatttttataaattttaaattgtacatcagacttttaaaatctgtaatatacaagcaagcaaaattattttaaatgacttaattgtatgctaatactcatctgataataaatgcttcttaaagttgacatttaactgctatcacaaagttttatatgtagaaaagtggggtccttttgaataaaagatcattcaactaaaaatattaaaatttatttcactggatggtaatgtaaccttaaaagcatcataataggtaaagtctaatattagttcccttaacaaaatcctaactgtataccagaattaggtcactgaaagaacttgatttgaattacgtttagacaaaaatgatttaattgtaaattcttaaaactttctaaatgcataattggcaaaaaaaaaaacccactgttaccagtgtaggaagttacaagaaggcacatactgaatgctgaagtatacatatgctatttctcttaaacctcagagcaaccatatgagcattgtaattaatattcccattttacagatgaggaaactgaagctaagagaagctaagtaatatgcccaaggtccacatctagtaacagacaaagctgggatttcagtctatgtctgcctctctccacatctctttcatccataccacactgcctacatgccatatgacaggatgtgtaatgggctaacgtttatttaaaaagttcaggccaggtgcagtggcttatgcctataatccccgcactttgggaggccgagccgggtggatcatgaggtcagacgttcaacaccagcctggccaagatggtgaaaccccgtctctattaaaaatattttttaaaaattaactgagcgtggtggtgggcgcctgtagtcccagctactcaggaggctaaggcaggagaatctcttgaacccgagaggtggaggttgcagtgagctgagatcgcgccactgcactgcagcctaggcgacagagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgac

SEQ ID NO: 384932 - DNA, 4349 bp, Homo sapiens
gatctagaggatcccaggagatagcaagactgcctcaaaaaaaaaacataaaaattcagtcactatactctggcacaattttcatttgtatatgagccaaaccacataccttaatgatttgggaagttaggcaaatatgagatatgtagacatatctatgctgattgttgcttgagaaataattactaattctagacaaaactcaatcctgtatcttccatcatgaatcttaaaatcatttcacttcactcctaacatttcttacattgcagaactaatggtaaagtaaattttacggaaaaagttaagatagctttgggaacagagacctttccctaaattgattccatagcagatttgggggaattaacaaagaatttcagtctcatcaatcctttgaatccatcttcaaaacttctgcttttaataactttagaaaatttactaatctatagaactaattgagtaggatataggaaggatacaaggatataatgtcctttttataaaagtttagtatagcttctttacatgtatccacttgttccagaaaatgtgcattggttctgaatgtgaaaatatttaaagagagaaaggaacactcaagtaagtgtgggcttcagtgggaattatcacaaaacattggcaagtatttttatttaaattattttcaaatttgacttctacagccaagtggaattggtaggctgtagctgttacactgaaatttctagtctttgtaagtgcctcctgaaagtcatttaaaatggaaaaatatttcaatgagcttttccttttttcatatttatggacatgaatattttattggagatcattaactcctagaatttgagattatatttccatacaacattttataaagttatgttgaacttactacctgttatgtgcaggttattatgtaactattcacagattgcttcatatattgctttatcttcccatctaacttcttaaagttaaaatccggacacacatgttgattatctagaccagtcattctggaaattgtaacactcccacataaaccccaggagactttttcagaatgcaatgtttctaaatgtactgttactggcagtttactctccagcatataaggttgcattttaacttttagattatgaactgtgcaaactttacccaaaactatcttgcatgattccctcctaaatatattccttgattaagtaaatctggcaaatcactgtttgagctagttacataaaatttgttatcaagagaaggcttttctacaagtttccagattaacataaagaaaagagggaatcacagggcatttaagtgcaccttcccattactttccttaaatcacctcatagttaggctgggcgcggtggctcacgcctgtaatcccagcactttgggaggccgagacggtggatcacgaggtcaggggactgagatcatcctggctaacacgatgaaacctcatctctactaaaaatacaaataattagccaggcatggtggcacgcgcctgtagtcccagctactcgggaggcagagacaggagaatcgtttgcacccgggaggcggaggttgttgcagtgagccgagatcgcgccaatgcactccagcctgggctacagagtgagactccatctcaaaaaaaaacaaaaaaaatcacctcatagtttatgtctgacttactccaaacctcagttatctgatttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcctctcaatgaacacttaagtctcaattcttcagacaaaattgcttaagctcttctcctcagtcctattttaatgactttatatttaagaatatagaattatattttcttttatattcaaattcattactccagttaagtaatagtttgatagtttgatagaatcgagagttaagatgtttctatttgaaagtggattcaaccatcagaccaccagcaaatcggcacttaatttttgtgttatctaacattttctattgtggaattttatgattttatattctcattagttataactaaaaagccatgcacacagaattgtatatcattttgccattaaaattttttaacatattgcagcaagcttagttttatgattgagccacaaccttttacatattttttgtatgaaatattaaacactaaatgcaagattaactttcaaaagcaaaccctacattaatcaggtattatcgatggacatttttgtagaccacttttgaaatacttattattttgcaacatagactggactatacaactttcatttaacttttaggtgactgatttaagttgagtgtgcatatagagaaaaacctagaaatttatctcatggcagatacatttgaaagtacttcagaagaatttatgctgtatattaaaactaggctcaaaataaatctatcgtatctttaaaagtccaattctgttattactgtgatgtttgtagtgttactattaaacattgtgaacatacacatttttaaaacaacttgaaacccattttaaaatctgggtaagagagaaggaatcttcagaacaaaatcacatcattagggtgtccagtttatgattgaatttttaagcaaattactgtatttgaaactacaacttgatttggttttcagttttaaaaggcaacatgtgggttttatccattttatttatacctttagatttcagaaacatcttcatgttttagatgcattctacagacatcatgttacttaaaaactcagggcccctttcatccctttgtacactgaaaaagttcaattgttagcaagtaagcaattagatccagttgaatatttaaagtgtttgttgcacagttcatttaatgtttcatcttatttgactttttcacatagatataatatcagatttcattaattataaaaagttgcccagttctgtaattactgaacagagggaatgactcaactaattggctacatgttgcaacaaatttaggcctttagagttgaagcactgacttaaaacgacttacatttctgttctttggtcaaatgaccatacatgatatgggacaaattgtttcattttgtttgttttttaataagggaacttggtaaagtagttcctgtcagataggattttctcaagagacaatttaacgttataaagccttctaaaagtgaactaaatattttataactttagtaatagcttggatggttttgagaaaataacctgtatttatcacattgtcaaacagaatttttctttgaatcagacaagttcaagctctaaattgatgtgctatatacttaaaatcctaggaagttatctgtaaccagtctcttgtctcaggctcttcaccttgttaccaatcctcgtaagtatgtaaaggaaacatatttttaaagaagcttaacagtaagaaaaaattactaaaagatgcaattcaaagataggtcccagtttaacactgaattgcttgacttctgtggcttttctttttctggccacatttatttatttaagcaatttttgtatgccttgttatttcatttccatagagattatattgtatcagtgtttatgtaagctggaatcatcctcagttttttgctgataatttttcaaataaagatacatggataattgtaaaatacactaactcttagggtgttgtagtagctgaaacatggagatgcgtagctgtcatgctttttctgaatggacaggagaaacataagctacggagtattcacttctgaggatgcttttccggaaaaagaaaggctagaaaatactcgcacttcctcagaaccctctttcttgttaacgggtatcttttgttggtgtgttttgctcttacattacagatagactatcatatatgactttatgaataatttcagttattttgcttttgtataagctgtctgaagccttgctatgctgtataagttgtgtttgatggatcagtgtgagtataaaataaagcaaatcacttttcttttgtattatctatggatgccactatgaaagctgacattaagccactaaagagttttctatgaataagtgtaagtaaatgctttgatatatataaacctaaataaaaagattgtattgatacagagacattggagaaggagattttaaggcagttctttaggtttaaaaaggcttgctgtaaaatggtgcgttattccgtttattaaagatcatattaatgac

SEQ ID NO: 384933 - DNA, 324 bp, Homo sapiens
cctgcccagctcccagtggccctggtaggcccacaacttcccgaagccaagttccccaggcccaggtcaggcctcacggtggcctctccaggctcagctcctgccctccgatggcatctgcaggccccaaacggcctccggtcggtgggctcctctaggcccagcttgggcctcccggcggcctctgcaggcccaaatcgtcccgaagtcggcctctccaggcccagcttgggcctcccggcggcctctgcaggcccaagtcatcctcaaatcggcctggaattgggcctggaagagcagcaagtcggcctccccgggcccaac

SEQ ID NO: 384934 - DNA, 326 bp, Homo sapiens
gaacaatatttaaataaactattgataaacgcagtggcacagatgcatctcaagtgtatcatgctaaatggaagaagctgctcaaaagactgtatcctgtatgatccatgtatacaacattccagggaaggcaaaactgtgtggaactgttctatatcttccacatttatcaaaactccgcctgtacctaaagagggcgaaattcactgtacgtaagttacatcttcatcaacctcatgttgcggggagaagaaactcttttccctcttgtgctgaagtcacatgaaagatgatgtaaatgccttgttgaggagtgaacgcgcata

SEQ ID NO: 384935 - DNA, 420 bp, Homo sapiens
tggaatgatgtgtttttaacttgctttggctaataaaatgcagcagaagtgatagtgtgtcagctaagaaccaagaaaccaagaatccaagagctcctgtgtacttctgtgtcttggagaaggcattgccatgtgaaagcctgagctagcctactgggtgataagagatgaatggcccagtcactctgttgccacagccagtagctaatgatcaggtacaggaatgatgcattttagagcagccagcccccagccaatccaccagcagacaacaatcatacccttgagcccagtcaagatcagctatgcctggcccaagtcagtggaaccacccaaaaggcttacaggcttgtgaacaataatacgtgtccattgctttaagctgttgagttttaggatagcttgctatgcagtaattgt

SEQ ID NO: 384936 - DNA, 553 bp, Homo sapiens
ttttgtatgtgtctaatattcagagtctgacacaataaggccataaagagctaagtctgtctatggtagatcttcacctgggaatgttctcctaatagtcacttttgttataaatcttcacctagcatgggagttaagtgcattttaaaactagacctggggactatgtatcctaaaatgcaaaaatagcccccaaaatgaaaattaatgttgagaatctagtcaatctgccagcagtacgtacataactgttctgtgtatatttcacatggccatatatgttttgcttgtgtggtgctaaatgcaaaggcagagaagcttctgctattgaatgcttagcacagaactcctgtcctccctctttgaaattattccgacagttgcccctcatttggcttgccaaggagtaagatcttggcttgtgtgtttctcccatgtgtggtgtatctgtaatctcggtcactgttgagagcctggtgggaggctgattattgttgagggaaagatctgagagcagggccaagaaagggaaagagagagagaggaaaaaaaa

SEQ ID NO: 384937 - DNA, 147 bp, Homo sapiens
cacaaaacagcaacctgatagcaaaagaaagagtgaaactcattggtaaaggtaaatacatagacaaatataggatactgtattattataatggtggtgggtaaattacttttaactctagtataaaagttaatagacaaagtatta

SEQ ID NO: 384938 - DNA, 341 bp, Homo sapiens
attatttttataattaaaatattttaatatgcataaatcaacattatttaaggttgtcactgagcccctccacaacatgtgagatcaacatgtgagatctcagattttgacagagttaaaatctttgtatgcttattcatgaatgatgatgaatctaaagtatatagtatgaaacttgatgttgaattcataaagactttttctatcacacacaagttctttcattaacatagtgaattataacagcactgtttctacatttgccattttttgatgttgaattgtgattgcaggtgatgatgaattgtgattgcaggtgaatgaaagtgattttatgaata

SEQ ID NO: 384939 - DNA, 3334 bp, Homo sapiens
cgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaagacttccttgtatatttggatttttaaatcatgcacatgtattatttttataattaaaatattttaatatgcataaatcaacattatttaaggttgtcactgagcccctccacaacatgtgagatcaacatgtgagatctcagattttgacagagttaaaatttgatgttgaattcataaagactttttctatcacacacaagttctttcattaacatagtgaattataacagcactgtttctacatttgccattttttgatgttgaattgtgattgcaggtgatgatgaattgtgattgcaggtgaatgaaagtgattttatgaataatcaccctgttttatctcatattcaaagaactaacacacaaacacctcaatcagggaattcgaatgaaacaaatgtcacccctcccaaagtgctgtgattaaaagtgtgagctaccacatttggccaaatctttaatttcttaaccttcatagtaaaggaaataaagagacatgggcattgaaaaatggatgttgtacaaaccaacctgtagcatctaaaatactaaataaaaaacagtttacaaaaaaaaaaaa

SEQ ID NO: 384940 - DNA, 803 bp, Homo sapiens
gtttcaccatgttgcccaggctggtcttgaactcctggcctcccaaagtgctgcaattataggcatgtgccaccatgcctggctaaattatagttttccattgaaacataaaatttctctctgtagtaaccatcatttttgatcataatcaaagtaagactattattgttttaaaaataagtctagttttgttagattttgcttgattatttacataagtgcagcaagaacaggagatgaccacataggtgctttcaagtttctttgctggaagttttcatacagaatctcagatttgacttttaaaggccttattcaggctaaaacccaagccaagcacatactatcaaatttcagccgcagtccttatggctttgtgtgaattcctctcttcttgaggcccccaaaatatccccaaattcctgggcctaccgggaaatgaccttctttactaacctgaaggctgtgaaccctgtaatctaggtatcaggctggcttttctcagagtgctgttgggaatgaagattttggtgttccaaaaaaaaaaaaaaaaaaaaaacaacgtgggaacaaatgatgtcttagcgaggcgagctttactttctgcataaagggtgctactcaatagctgtccagccacaagagcacaccaaacaaaggagacagagttacttataacctgatgtgtctaccctagtgctgtgtccagtttccactggctgaaataggacctcacattttacactttacccgattgactattagtttaacactttcttaattaggtaaggggaatagaacaa

SEQ ID NO: 384941 - DNA, 352 bp, Homo sapiens
taagtgctctgagtttgtgttgcctcttttgtaaaatgagggtttgacttaatcagtgattttcatagcttaaaatttttttgaagaacagaactttttttaaaaacagttagatgcaaccatattatataaaacagaacagatacaagtagagctaacttgctaaagaaaggatggaggctctgaagctgtgacttcattatcccttaatactgctatgtcctctgtagtaccttagatttctatgggacatcgtttaaaaactattgtttatgcgagagccttgctaatttcctaaaaattgtggatacattttttctcccatgtataattttctcaccttctatttaaa

SEQ ID NO: 384942 - DNA, 391 bp, Homo sapiens
gatactacccttttaatagataacagtttttgccagcttctgtactagatgtgtattggagatacagaaatcaatatggattgggaatgtggttggattcataaaaaggattaagataaaaaagaaagaaaaggaaagaaagaagatatagtagcattttaaaattattttccatggtctaagcagcatgctaatcacatttacatgtaaggagtcgtggaattacagagctggaatggactttgagatcatctctcaaaccttcttattttacagaagtaactatgtcacaaagcatttaagtggctcatccaaggtcatctgactatttggttgtagaaggcatcaaagtccaaacgtcctatctcctagttgagtgttatttccttta

SEQ ID NO: 384943 - DNA, 345 bp, Homo sapiens
ctgatgaaagagttgttgcatgtctaaattacttatgactctcagatgcagggtaggggtcctatggttggttagtactactcttccacctccccaagaagctgtcttaaatgatggttaacctggaattagaacatgctaacaatggcagagtcttttagactatattcacacactgccctgtggaatcctcagcagccctctgtataatgagaaattatgatacttcctggattgttcccgaaaattagcaattagcatatgattaaaaaaactgtgagataagaatttctttttatttatttacttatttttggcagagtcttttgctctgtcgccctggct

SEQ ID NO: 384944 - DNA, 407 bp, Homo sapiens
gcaagctcatccgtggtcatcccgtgggcacgtggcctggccgtcctgtggtcatcctgcaggcatgtggcatgttcatcctgtggtcatcccacaggcacgtggtgtggccatcccgtggtcgtcccgcaggcatgtggcatgctcatctgtggtcatcctgcaggcacatggcctggccgtcctgtggttgcagctatcccttgcgtggctgcagcatcctgtgctcgtgtttggcgttctgctgatggccagtgatgttgagcatctcttcatgtgcttcattcggctaatcatctctcttctttggtgaagtttctgttcagtcttttgcccattttttattgggtgacttgccttcttgttattgagttgtaagaggtcattatctgttttagatagaagtc

SEQ ID NO: 384945 - DNA, 1320 bp, Homo sapiens
aacaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagtgcagatcggcctgccctccaccatgcgcatgacagtggctgacggcattgtatacatagcccagcagatgcactttcactggggaggtgcgtcctcggagatcagcggctctgagcacaccgtggacgggatcagacatgtgatcgagattcacattgttcactacaattctaaatacaagacgctatgatatagcccaagatgcgccggatggtttggctgtactggcagccttcgttgaggtgaagaattaccctgaaaacacttattacagcaacttcatttctcatctggccaacatcaagtacccaggacaaagaacaaccctgactggccttgacgttcaggacatgctgcccaggaacctccagcactactacacctaccatggctcactcaccacgcctccctgcactgagaacgtccactggtttgtgctggcagattttgtcaagctctccaggacacaggtttggaagctggagaattccttactggatcaccgcaacaagaccatccacaacgattaccgcaggacccagcccctgaaacacagagtggtggaatccaacttcccgaatcaggaatacactctaggctctgaattccagttttacctacataagattgaggaaattcttgactacttaagaagagcattgaactgaggaaagctaagaggaagattcaataatattaactagcttgaagcctgacctagccagaagtgcctgtccgctgcagccgcaccctaccttgtctaagaaaccatgtgtgtctggaacacgctgctccccctgggcagctgttgggattctgattaaaagaggggaaacgatcatcctggacaggaagtgagatggcttcagttcatgagacgggatctgagttagacatcaccagtggaaattgattggaatagaaacttaaaggaaatggaaccctaactattctcccatcaaatcatatatgttgacctgtctgaattataaaccagcctgacctttcctttagcattagatgtaataaaataactttggaaatttgtcattta

SEQ ID NO: 384946 - DNA, 831 bp, Homo sapiens
aacaccatgagggccctggtgcttctgctgtccctgttcctgctgggtggccaggcccagcatgtgtctgactggacctactcagaaggggcactggacgaagcgcactggccacagcactaccccgcctgtgggggccagagacagtcgcctatcaacctacagaggacgaaggtgcggtacaacccctccttgaaggggctcaatatgacaggctatgagacccaggcaggggagttccccatggtcaacaatggccacacagattggcaggcggaactcttcctcccctccttgtcctctccttgtggagaaggggcgaagcacaaaggccaaaggcagtggctttgttcaccctccctggacagctggtgggaagcaatcattgatggaggatctctatgggcaacgcttgctgagtgcgggcttcgtgctgagggcccagaagagggaaggcatatggaagagaagagcccagcttcccaaggggcttgcagcggctcccgcctcccaatttccagaggaccctgtaccttcttcctttagggctctgctcaaatttctgtggtccggaagcctgttcctttggggttctcacctcacacgacagcatgtcggacattagagtggacccaaagttcacattaattatatatatattaaaaacaatttttttttttgagatggagtcttgctctgtcaccccggctggagtgcagtggtgcaatcttggctcactgaaacctccacttcccagattcaagcaattctcctgcctcagcttccctggtacctgggactacaggcatgtgccaccacgcccagctaatt

SEQ ID NO: 384947 - DNA, 2162 bp, Homo sapiens
cgcggcgagtcggtgggcggaagcgaggggcgtccggcggggccctggagggtcgcaggagtcgcaggccgaggctgaaccgccccctcttccgcccggtgcgttccccgcagtgtcggtgaaggaggagccggaagcagaggtgcgcatggtgaatgggaagcccaagaaggtccgaaagccgcgtacaatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacatgccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaat

SEQ ID NO: 384948 - DNA, 2599 bp, Homo sapiens
gcatttgattgtggcttgggacgcgaggagaggcgcgcagcgaccgcctgacggcaggcaatggtgtaagcgcctctcggcctccccctccccccagacgcggccgggtcctcccttcgccttctggacacacacccctgcctcgtctcttccgcctctctcgcactccggtccgttcctgtcctctgcggaggccagccctggggaggtgcagcgcccgccaggatgagtggctccttcgatcgcaagctcagcagcatcctcaccgacatctccagctcccttagctgccatgcgggctccaaggactcgcctaccctgcccgagtcttctgtcactgacctgggctactacagcgctccccagcacgattactactcgggccagccctatggccagacggtgaacccctacacctaccaccaccaattcaatctcaatgggcttgcaggcacgggcgcttactcgcccaagtcggaatatacctacggagcctcctaccggcaatacggggcgtatcgggagcagccgctgccagcccaggacccagtgtcggtgaaggaggagccggaagcagaggtgcgcatggtgaatgggaagcccaagaaggtccgaaagccgcgtacaatctactccagctaccagctggccgccctgcagcgccgcttccagaaggcccagtacctggcgctgcccgagcgcgccgagctggccgcgcagctgggcctcacgcagacacaggtgaaaatctggttccagaaccgccgttccaagttcaagaaactctacaagaacggggaggtgccgctggagcacagtcccaataacagtgattccatggcctgcaactcaccaccatcacccgccctctgggacacctcttcccactccactccggcccctgcccgcagtcagctgcccccgccgctcccatacagtgcctcccccagctacctggacgaccccaccaactcctggtatcacgcacagaacctgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacatgccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaat

SEQ ID NO: 384949 - DNA, 1659 bp, Homo sapiens
acgggcgatggtactagagagaggcaaacaaattattggttcatgcgacataactgagtggaccccacttacagcagcagccgcctcagccagccaccctgcaccatgcctctcccgggcccccgcccaaccctggggctgtgtactgagcacccatctggcctgcacccttgacaaaggaccccaggaccaggcagaaggcgcctccgtcctagccactcaggaatcatcgaggagcacagggaaaaggaactccctttccccctcccttgccccttcctccagggacccaagcgcttccagatgacatttgcatggaccaaggatgccccctgaacctccctccctctgcctagacactggggtacccctccagatgtggggacattccaccccagtggggacagccattcccctacctgctccaggagcctggattggctttaaatggctcatcatcttccagcttcttaaacttagtgcctgttcccagactggagaccttgggatgggggagagtgtggagggtttgcgggtcctgcctgtgctggggcacctggcaccgtggatcttaaaacttgccaggcctagttcctcctgagcctctggtggtctccccctgctcgagcggcccctcggccaataagacagtggacatcatgacgaggactccgggtggggacctgaactggtcaccgccctgcacttctagccctcatttaagatttgagggtgaaaccaaagaaaaccccctaagtgagggaatcttttaatatttgtggctttagaggaaagaactaaaggagccatctctctcccctctcctccgttccgagaggaggggtgggtctcagacgtttttcctatggacttatttcttccatgtccaggactttgcacaactttggttttaaaagctgttgaaaaataggaaaacaaagggcattgttcacagatagggccaagtctccccttgcaagggtgcctctgttctgtccctgcccccacctcaccttctctactcctccagtaagttggcagttttggtgccaaaccccaaatctccaaagagacatgccaggcaagacaaacccccaaacacctcctttccggtggccttggaaacagattgctccgagctggagaatgtcgggtgaggtgtatgggagaggaggggagagttagaacttgtgcctttgggagtaaggggtaactgcctggagggctggtggcactgcccctccctgacccagacatcccaccaaagctaactttcccccacccctgatgcagtaaaacattgaaaaaaaaaaaaaaggagaggtagaagactgtagctatatatataaatatatagtaagttttttttttttaagagcaacagagagaagcagcctcctccctgctgcggtttcctatttatgtggccatgttcctcctggacggatctccctgtgtgtttcaagctgagagatgtgggctccggctggatttgggttttgtgggaggtgcaggggccaagagagacgtggtaggtctccaagagtcccacccgggggggaagaagcaaagccatctcccaccccctcctagccttctcatttctgctttcttactggactcatctttatatataatgttaataaaaaagacgaaaat

SEQ ID NO: 384950 - DNA, 381 bp, Homo sapiens
tatggcagttactgagctgaaaggattaaatgctgcagcttccccagttgcccttcctccatgagagcagtgcctgcccccagcattctgtggcacttggaagacaagacagaggccaaatgcagatttttaccctgggcttccctctacagtgtggaactcaggttgtttcttctttcctccctgaaatgacatgagtttgcagcggatggtgaactgaagaaaccataggaggctctgtcttcttgcctgaatttcagttggaagcttggagatttggggttcaacagagataaggaagtgtaagccttcatcccgtctggtggttggcgatcacacaccgctctgtgctgaggctaatggccatgatcagagttgacc

SEQ ID NO: 384951 - DNA, 149 bp, Homo sapiens
accccagagtcctcactcctggctgtgcacttgaatcttccctttccttgtagacacacacacacacacacccccacacccctttagaggcatgcttatactttgtacattcatttattgaacggcagtagtgttccaggtagcagcct

SEQ ID NO: 384952 - DNA, 167 bp, Homo sapiens
aaataatagtaatagcaaatttaagtaataagaaatctttgagtactttctaaactgtaggcagaacaatccacagcaatcctatgagataggtactattattattattactgttttattgataagggacttgaggcacaagaatagatgtccaaggtcagacatct

SEQ ID NO: 384953 - DNA, 671 bp, Homo sapiens
gagcagaatgaaaatgaggcccagtggagaagtgatatttccaagatcaccctggcagacaccaggcctgtttgagttgtggcccatgctacctcccacctattctcctaatgcttccatctctaagtgtgtgcattatctacaggtgacactacatcattatttttattgtcttatcttatatacacctaacacattccctaggaagtagatgttagcatcatcaccactgtgcatgttaggaggctggggaagccttgaatacagtgacttttactgggtcccagagatggtaagaaaaacaaagttatgttccagctgtctcttctctcctggaacccaggttgcatttaggtctttccagggaattaaggggaagttgtgtttgcataattgtgtacaaataaagagttgacatggaagaggagactgagcaatcagtagcatagtggggcctttcggtatgtcttacagaaacatagggcccagtagatggaaccttgaagagtttaacacactttcttggtgtcagaacccaacagcagttaagaaaccaggaatccacattcttgagacagctctgtatccacctctgtttgtgagagttgctcaagagagtgagatgctctttcattgtgccctgaaatttctgagtttcagccttacaaagg

SEQ ID NO: 384954 - DNA, 777 bp, Homo sapiens
gaactccggctgcgttaccgacctgcgagctgacgggcccggaccatggggtgctgcccgggggactgcttcacctgctgcacccaggagcaaaactgctgtgaagagtgctgctgtcagccgggctgctgtggctgctgcggctcctgctgtggctgtgggggctctggctgcgggggctctggctgcgggggcagctgctgcggatcgtcttgctgtggatctggctgcggaggctgtggaggctgcggaggctgcgggggtggctgctgtggatccagttgctgtgggtccagttgctgcggctccgggtgctgtgggcctgtgtgctgccagcccacacctatatgcgacacaaaatgaagacctttccctccaccactgatgcagtcccaccgaaagcctccatctgctccagggggacagcccctcgtgtccagaaccttccatacccccaagacagtgtcttgtctttctgtgatttgtagaggagggcttgttctccaacaccttctctggtatttcaaggcaccgagaacaagagccatactctgatgaaacattaaaactcggtcacaactaagtgatcccaagctcaagggtgaatccccaatactttacttattcacatgaagttcaatgtcttgtactataagacatcctcttcttcaaggtgtctttgggactgatcctccgccctggctttctgcagctttgagatgcaaaaaaggtccatcttctttgtgagcctcttaataaatttgagcatgctggcat

SEQ ID NO: 384955 - DNA, 2110 bp, Homo sapiens
tgctccagttcaaattcctagtgttctcatatggtttatattactgaaaaattaatatctttaagctaaaatataagggaaaggaagaagagaaatttagatgtaaaatgtgggtcagatattttataggtttccatttaatatatatatacacacaaaatccagtatattctgagtaggttcttagttttctgatttctacatgtgtctgctatgtgcaaatgtagtatattatttactacatggttattgtggtgtagtgtgcaaatgttagcatgtgcattatcctgattactggacacagttttattcttatcaggaatagaacttgcacatgtaccatacaatttttttttttttaatcacaaaggatgtatttccctaagtagcacttttggagcaggggaaggaagaaaactgctattccctaatcctcctcctataagatatgcatatgcctgaggtgtataaagacatttaggttagttaatgggcatgttaataagagcattgtgatgcaaattcattttcaaaatgaaaataattttttcttccccaaaatgagaatagtagaaattttggtgaactgagcaccatagttatataatatttccctgcgaaggtctagtttgaagaaaaaaaaaacttgaaaacaaacctatgaggttgagcctggttgctataaagactttgggatggtatgtgtttctgggatgagctatatagaaagtttagttgactgctggaccttggatattcttactcggttcaaaatacacaaaaacaagctggtacatatggtgctttataatgcagtcgagagtaagaatacatgttgctgtagccccatttcctttacaaacccccgcacaatttcaaaagtggaagttaccgtggcctctggtttcccagttcctccgtggtgtaatgaagtcccaggttttagaagctgaagccaagcctagggtagcatcgtctgtacggtggtgaggcccagcacagcggtagctgcctagtggggaatgaccccctgagcatgcagagcccagagtcactgtccatctgcgttcccagagaacaattgtgaagagtcctagaacaggaactctgaatcagactgtcaggggcctatgtagccaaaatgttactaaatataaaattcctgtcgtcttcagtcttcatgctttgtcactgtaaaaagaacaaaaagcatttttactataatttaaaggagctgcttttttatagcacatactatttcgctttgtactatatttgatagttgcagaataatttagactgtagaaaaactttgttgtatttgtactgttcttgaatgtttcaaagaaagtgctttacttggttgccataattttcttgtactgctgtattcccctccttcccctgcttcatggaaacctgatatgatacatattttcagtagttttttttttttaatgtgtgttcgtttgtacaattttttttttttggtcagtattctgaatgtttacatctgtttgacattagccatttaatgccttttttaaaggcggtattactcctacagtgtaacagcaaaatgtgaaatcaacccaaacataacatgcatgacaaacacagattgggggcgaaggccctgaacctacatagacattttatatcagcatacagaaaagtaaaatcctccttcagtcctctaccaaagaatatattattcccacaggaaaaactcagaaaaggtgtgtaaaatcctcagaagggggagcagttgattcagtaagactgcgacaatttaatactgttacgcttgctttgatacctgactaaatgtgactgagtgcaacaagcatttaagaaaatttttagacagtgttttgtttagaattcagggatcatgcattctttaatggtgctgtttgttttttatttcttttctacaaagaaaacaagtgttgcctacaaaagtgactgctcacaataccataagttaaatgaaatgaaatgtttgtctcttcatgtttctctgtctttccctttctcaaagtaacaacttgggtttcaatattaagatattctggagaaaataaagaaattaaacatgaaaaaaaaa

SEQ ID NO: 384956 - DNA, 337 bp, Homo sapiens
aaaatatctgtgaagtggctacttcacagatgattaaaaatagaagtaccctattaaggaagtagaaaatataacactttaaataaaatttagaatattactgtaaattggtaccaaatttaaagaaatccagcacagacaaggcattacggagaaaagaccaagatttctcaaagcataagtaagctttaaaaactggaataatgggccacggtggctcacacctgtaatccaagcactttcggaggccaaggtgggtggataacgaggtcaggagatcaagaccatcctggctaacacggtgaaaccccatctctactaaaaatacaaaaaaatt

SEQ ID NO: 384957 - DNA, 377 bp, Homo sapiens
ctccattttgtcctagttacttttaaggtataagctgaagtcattgatttgagatgtttcttcttttctaatataggtgtttaatggtacatatttctccctaagtactgctttagtggcatcctgcaaattctgacatactgtggttcattttaattcattacaaaatacttcttaatttcccttttgatttcctctttaattcatgggttacttagaattgtgttatttaattttcaagtacttggcgatttatctctctctgttattcatgtctaatttaatcccagtgtggtctgagaatatattttgatatcaataaagctactccagctaccttttgattaatgttatcacagtatatctttttctatctt

SEQ ID NO: 384958 - DNA, 306 bp, Homo sapiens
tgggaggctattttcctagtctttctttccactctcacattttatttcatctccagcaatacacccctactaaaagttttctaataaatatatttctaaaaaatataaggaccccattttcgttggaaaaaaatgtggctagacaaaaatatggcatgatatacatagaacattaacattatatatgggtagcagatttgttaaagtcaatttttatcattttttgttcttctatatcttctagaacaaataggtattacttatttgctcagttcagctgatgttaggggaaatccattatcatgt

SEQ ID NO: 384959 - DNA, 415 bp, Homo sapiens
cacagctcctggcacatgctctgtgctgctgctgacacgagctggaagcatttcccaagctcaaggcctgagacattgaggtttgagtggagatggctaataaatgaatttcaagggaacacccctgagtaactcactcagcacaggcatctgcctcccaaagatagtatagggacccctggggtggtacttcgcactccggccttggaaaacacctgaggtatggctggggtgtttaacactcaggttttccctaaaaatccagcaggttcagctaagaaagaatcacagagggccagccatggtggctcaagcctgtaatcccaacactttgggagcctgaggcgggcagattgcctaaggtcaggagtttgagaccagcctggccaacatggtcaaaccctgtctctactaa

SEQ ID NO: 384960 - DNA, 2212 bp, Homo sapiens
  misc_feature (1754)..(1754): n is a, c, g, or t
cccgggtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctcttttagaccactttttaaagctccctttcctacaaactacaaaaaaacagagttgttagaaatgacctggagaggagaaggaaaaaaaaaaaaacacttcaggagaaacacaaaatgtatcaattgacacttcaaatcttgtcatcttgtccccagatgccttctgcattttgaagacaagaaaagttaaacacactttgggaggctgaggtgggtggatcacttgaggtcaggagttggagaccagcctggccaacatggtgaaaccccatctctactaaaaatacaaaaaagaaaaaaaattagctgggcatggtggcacatacctgtaatcccagctacttgggaggctgagaaaggagaatcacttgaactgggaggtggaggttgcagtgagccgagattgngccactacactccagcctgggccacagagcgagactccatctcaaaaagaaaaaaaagaaaagaaaaagaaaaagaaaacaaaagttaaacatactcaacatcatgtgagtaccaggcacaccctgacaagcaaacacaaagccaggatgtcatatccagctgttccctgtctccactgaaaggataacaagttctctgctctcctccaaagcattctctctggttttcaaaaccactaccaataagatggtcctgggagtagggggcgctgagagacatccactgagcctcaaagctccactaaccttcttatccacagcagcctcctttcttccctagtaggttgtgggttagaaattacttttttttgggccaggcgtggtggctcacacctgtaatcccagcactttgggaggccgaggcgggtggatcacttgaggtccggagttcgagacca

SEQ ID NO: 384961 - DNA, 4691 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384962 - DNA, 4637 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatatagttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384963 - DNA, 3413 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttag

SEQ ID NO: 384964 - DNA, 2181 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctag

SEQ ID NO: 384965 - DNA, 4571 bp, Homo sapiens
cccgggtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384966 - DNA, 4376 bp, Homo sapiens
ttttttcttctgcttttggttttagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384967 - DNA, 4513 bp, Homo sapiens
agctttccaggtgattcccgtatgattccaatgtgtagacaagtttggggactatagattaatggctttctattccttccatagtgtctcagctacttcagcatgtggttctgaatcttggctgcacattagaatcacctaagaagcttctaaacaatactgcttcttgggccctgttctgcataagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcagcacctattatatgtcaggcactgttctaagtactgaggatacaacagtgaacaggacaaagtctctgacttcatggagcttgtgttctaccggatgtgcaaaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384968 - DNA, 4484 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384969 - DNA, 2048 bp, Homo sapiens
  misc_feature (1990)..(1990): n is a, c, g, or t
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaaaaggaccagngagaatagaaccatgaggaaacataggtggagtgggagagaggtgtgacaatgtttgc

SEQ ID NO: 384970 - DNA, 1399 bp, Homo sapiens
ggcggtaggagttcggcggaccgagaggttccgcgcccacttcgcggcccagaggactgagcccggcctccggtgcaaggaaaccccagaggccggaactagaattgcaaattttttttcaccccggattccaacggcattctgttataagcaacagagaatgaacgaagacagaaaattggaaccaagaagtgggattttgctgatgacaaatacctgaaaatggggaagcagctttggaactaggttctcactctgttacccagactggagtgcagtgacacgattacagctcattacagcctcaatctcccaggctcaagtgatcttcccacctcagcctcctgagtagctgggactgcaggtacaaaattcagtaggacacgactttctgagtcatatgctggatttgaggagatactgaagccacaagactgaaataacttttaaactgtgggtgatttggctaaaagctactctcatctattatatattcatcttactagttttgctctcagaggaagttcctgtttccaaggacaatgatttaaggcattgaagtggaactgagacacttggatcaaatccctgttctgccacgtgcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcaggtgaatatctcacagcatccatggaggtggctctctggaggccaatgccattgctatctcaggcagtacttgggtcgctagccagaatgaatgaatgaatgatagatggatggatggatggatgactggatgaatgaatttactctcacatttgtaagggtcaccagaggtataattctcttacaagaccttctactattgggagaataaggacatgtctttaccttagggaggc

SEQ ID NO: 384971 - DNA, 2061 bp, Homo sapiens
cccgggtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctag

SEQ ID NO: 384972 - DNA, 588 bp, Homo sapiens
ggcggtaggagttcggcggaccgagaggttccgcgcccacttcgcggcccagaggactgagcccggcctccggtgcaaggaaaccccagaggccggaactagaattgcaaattttttttcaccccggattccaacggcattctgttataagcaacagagaatgaacgaagacagaaaattggaaccaagaagtgggattttgctgatgacaaatacctgaaaatggggaagcagctttggaactagagccccaactttttactgagcacaatatagccaaaagatgacattgcccagcctctttcgcagatagctgtggctattccaggatcccagaaaatggtagccacaaatgaaggcctctgaagcagaactgccctggatctttactgtgctggtgccctctcggactttctcttgcccttctgtctctggcctctcattctcccccgagaaatggaaactagaattcctcttcccccaggtgggtcatagaagccagcaacaaaacctaaaaatatcactttaactttctctttctcccagcctttctgtataaaaactggccataaagaaatgatctgaaat

SEQ ID NO: 384973 - DNA, 4576 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggtaccaatctgaagtgggagcggccg

SEQ ID NO: 384974 - DNA, 3196 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttag

SEQ ID NO: 384975 - DNA, 4568 bp, Homo sapiens
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384976 - DNA, 4958 bp, Homo sapiens
ggcggtaggagttcggcggaccgagaggttccgcgcccacttcgcggcccagaggactgagcccggcctccggtgcaaggaaaccccagaggccggaactagaattgcaaattttttttcaccccggattccaacggcattctgttataagcaacagagaatgaacgaagacagaaaattggaaccaagaagtgggattttgctgatgacaaatacctgaaaatggggaagcagctttggaactaggttctcactctgttacccagactggagtgcagtgacacgattacagctcattacagcctcaatctcccaggctcaagtgatcttcccacctcagcctcctgagtagctgggactgcaggtacaaaattcagtaggacacgactttctgagtcatatgctggatttgaggagatactgaagccacaagactgaaataacttttaaactgtgggtgatttggctaaaagctactctcatctattatatattcatcttactagttttgctctcagaggaagttcctgtttccaaggacaatgatttaaggcattgaagtggaactgagacacttggatcaaatccctgttctgccacgtgcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384977 - DNA, 4633 bp, Homo sapiens
agctttccaggtgattcccgtatgattccaatgtgtagacaagtttggggactatagattaatggctttctattccttccatagtgtctcagctacttcagcatgtggttctgaatcttggctgcacattagaatcacctaagaagcttctaaacaatactgcttcttgggccctgttctgcataaggtctgaatatttctaacatgcaaacagcatgaagagccccgttctagcagggttgttgtcctggtagatcttgtgatcggagtgactccagtgccatcccctcaatgttcctctcaaatactttctcctcatgtttttgaaaattccagtcctttcttttgcaagcctaatatggagatgagtgatgtgatactgataagtttttggtctgtgttgctttcagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384978 - DNA, 3661 bp, Homo sapiens
tgtatagaattttccagttgtttatatttattaaacattcatatgtagtacatagtatttttaaatgggatttttgcaacccctttctctctcttttcttattctctttccccatttttctttctccctgactcttctattacaattatggagaaaagtaactgccaggtggcttagaaatgtgtgtcagcagcaaagtggctcctcttccaggaaggaaacagctcttgggcctgcaatatcactttgtgtgttaatttactcagcagaactttccaggcacctgcacaagggatgcggcctttaggagagcaagttggcatccctctgtgtggaacacagcctaaaactgcgattttctcttgtaggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacattgcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggaga

SEQ ID NO: 384979 - DNA, 1846 bp, Homo sapiens
  misc_feature (1388)..(1388): n is a, c, g, or t
agggaaaaagggagaaagagagagagattggaatatacatggcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcagatgccttctgcattttgaagacaagaaaagttaaacacactttgggaggctgaggtgggtggatcacttgaggtcaggagttggagaccagcctggccaacatggtgaaaccccatctctactaaaaatacaaaaaagaaaaaaaattagctgggcatggtggcacatacctgtaatcccagctacttgggaggctgagaaaggagaatcacttgaactgggaggtggaggttgcagtgagccgagattgngccactacactccagcctgggccacagagcgagactccatctcaaaaagaaaaaaaagaaaagaaaaagaaaaagaaaacaaaagttaaacatactcaacatcatgtgagtaccaggcacaccctgacaagcaaacacaaagccaggatgtcatatccagctgttccctgtctccactgaaaggataacaagttctctgctctcctccaaagcattctctctggttttcaaaaccactaccaataagatggtcctgggagtagggggcgctgagagacatccactgagcctcaaagctccactaaccttcttatccacagcagcctcctttcttccctagtaggttgtgggttagaaattacttttttttgggccaggcgtggtggctcacacctgtaatcccagcactttgggaggccgaggcgggtggatcacttgaggtccggagttcgagacca

SEQ ID NO: 384980 - DNA, 644 bp, Homo sapiens
ttcggctgttggtcgcagggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaaggtcacagctttgcagggggttgacatgggctgtggcttcctggaaatgtcaccctcaccagagccttttacatggatgtgaattttgagacatgaaggagggtaattattggtttacccaggagatgctaagagcagaggagaaaaccctaatttccaggcatgtgacttga

SEQ ID NO: 384981 - DNA, 401 bp, Homo sapiens
tcagggacagctcagtcaggtgagggtggggatgacccatgggcttctggagctgggctggtggtcctggaagggccggcccatgccccttggagagggtctttgtgctgagggatgcccacagaggcctgggtaccaggaacactgctccaggcaaggggcctttcttccagatttggctggaaggaagacttggtcagcttttccaccttgcagggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataaaaaagag

SEQ ID NO: 384982 - DNA, 657 bp, Homo sapiens
ttcggctgttggtcgcagggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaagggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataaaaaagag

SEQ ID NO: 384983 - DNA, 758 bp, Homo sapiens
ttcggctgttggtcgcagggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaaggtcacagctttgcagggggttgacatgggctgtggcttcctggaaatgtcaccctcaccagagccttttacatggatgtgaattttgagacatgaaggaggggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataaaaaagag

SEQ ID NO: 384984 - DNA, 366 bp, Homo sapiens
aaaatttaattcaactgacccatcccaccgggaaatgccactaggaaggtgtagcctgcagttttacctaataagcacaactggaggggaatagaaacacagaattgtgagggaatcgcaaggcatgctgctcagagcatgcctagccctgcactgaaagctatgagatactggttctgaggcatggctgtgcttgctggtgggagcgggcatcctcccttggcctccctgggacacctcctgtgctccctgcactgcactccacgtgcctggggtgtctacacaactcgctgcagcttcactaaagaacaggtggcactccagcttctccgggtcctgctgagcacagggccccgccacccttga

SEQ ID NO: 384985 - DNA, 739 bp, Homo sapiens
gatgggtttcctgaatacagcacactgatgggtcttgacgctttatccaatttgccagtctgtgtcttttaattgatttaatggtgagagagaaaaaaaaattgcatctagttctctttgctatctcccatgaatcattgcatttaacatgttatttctgctcaactttagttcattttcaatgtgcatttttagtgatgtcagagtatgtgtcatttaattaaatccccgcccttgctttagattttctgtgcatggggtgtgaggcacatatgcagtctgtgccatgttgtatttgttttgtaccatgttgtttggcctattttgcttccatgctgtcctccattgttaaggtgatttggagttgttttacttttgaattttatcctttctgttcttggtgtgacaactttctaaatatttccttattaaagtagtgatatatagatgatttcctttttaaagcatatttactatgtcctttaatgttttaaacagttttatggaggtatttattgaagtatttttatcaaacatgactatttaaaatccctatcaactttgtgtagtgattctttcttgttctatgacacttagtaatatatcttagaatttgcatcttaatttttttctaactaaatctcagtcctaatcccatatcattttttatttcttttgatatgtgtgtgtatttattccctttgatgttcatagtatgtttcattgaggttcaaggttg

SEQ ID NO: 384986 - DNA, 450 bp, Homo sapiens
ctgaggttttttttccctgtaaccatttgtatctcattttattataccacgtctatttggagtgctcaaatcacccttgcagaagtacacaccgttgggttgactcatttgttcatcagaaaaatagctgtagtgtatcaagtacatactaagtgccaagtgttcaacatcagtttccttatctgtgaaatggggatcctgagaactacttcattgggtgcatataaatcagttaataagttactcctgtctatgtaacaggcctcagttttgagctacaggctagactttgttgacctgaccatagagctgctgttccatccttcatctctgttgaaagctcctttcttctgcatcctctctgttgcttgttgttcttttttttttttttttttttttgagacggagtctcgctctgtcacccaggctggatggagtgcagtggcacga

SEQ ID NO: 384987 - DNA, 243 bp, Homo sapiens
ccctggggcccaatactgactccccggagcctggccctccttctgtggggcctccatccctgccccatcctgatcctggggccctccagccccaacatgggcacctaaggctgaaccagtcagaccccggggtcttcaccctaacccgagagttcccgggccctaactctgcccccgatcctgcccctccctcctcacactccaggcccctcggttccacgattaaaagtgcctggttccaga

SEQ ID NO: 384988 - DNA, 916 bp, Homo sapiens
  misc_feature (916)..(916): n is a, c, g, or t
tccccttagagacagggtctcgctttgttgctcaggctgaagtgcaggaaagttagtaaagtagtgaaggataagaagctttacttcttcatgatcatatctgagtgactgcagaatgaagcatttgtcagtgtgacagggaagacataaatacagaaccttgaggccaatgaatgtaactgcctatataacttgaacagtttgaatagtgatttagtgtacttcttgattcattcctcccttctatgtcaaatttaataaagtactttaacaggaagaagacatcaataattttttatatataatcgctttttgctacacattctttttttttcttttaacagattattgcttgggacttctgctctagacccaaatagttcaagaggttgaaaagttttaggatggtctgaatgaatcatcaaatcacattccctgtgatcttttctcagccaacacagccagaatcaactgcctacctccatgtcccatcctattcttggtgtctctacaatatagttacgataaaacctattaattataaagaaacacaaagaaggttaggtttgcatgcacacatgtgaataggtgtatgggtaaaataaattcttttttttttccccttagagacagggtctcgctttgttgctcaggctggagtgcaggaaagttagtaaagtagtaaattcttaaaacctatggttccttctatcagctccttaaattcttgtatttttgaaggataagaagctttacttcttcatgatcatatctgagtgactgcagaatgaagcatttgtcagtgtgacagggaagacataaatacagaaccttgaggccaatgaatgtaactgcctatataactttgacagttttgatagtgatttagtgtacttcttgattcattcctcccttn

SEQ ID NO: 384989 - DNA, 703 bp, Homo sapiens
tccccttagagacagggtctcgctttgttgctcaggctgaagtgcaggaaagttagtaaagtagtgaaggataagaagctttacttcttcatgatcatatctgagtgactgcagaatgaagcatttgtcagtgtgacagggaagacataaatacagaaccttgaggccaatgaatgtaactgcctatataacttgaacagtttgaatagtgatttagtgtacttcttgattcattcctcccttctatgtcaaatttaataaagtactttaacaggaagaagacatcaataattttttatatataatcgctttttgctacacattctttttttttcttttaacagattattgcttgggacttctgctctagacccaaatagttcaagaggttgaaaagttttaggatggtctgaatgaatcatcaaatcacattccctgtgatcttttctcagccaacacagccagaatcaactgcctacctccatgtcccatcctattcttggtgtctctacaatatagttacgataaaacctattaattataaagaaacacaaagaaggttaggtttgcatgcacacatgtgaataggtgtatgggtaaaataaattcttttttttttccccttagagacagggtctcgctttgttgctcaggctggagtgcagtggtgtgatcacggctcactgcactctgcaactgctgg

SEQ ID NO: 384990 - DNA, 811 bp, Homo sapiens
ttaagcctacagagaaacatgtgacatttcacttaagaaaatctagatttccaaattttcttgaaaaatttgaaaatcttgtaagcattggctaaagtttactatcctctcttagtcccacatcatttcaatattatactttttcctgtttttttccccaaaagtcttagctatgattctcacttcattcttccatttgactttcctaattattttgtttctctagaaatgtgatatatactgccagtttattaaaagcttctatgttgctttttagtaaaaacggatcggttttcataatttcagttctatagatacttgatagtagttgctgttgtgaatgttccccttgctctttatatttcttaagtggtcattgttggtgtgttcttgtaggaaatttccattggcttgaactaacattttatcatgttaaagaactgtctttttatttttattttactaagaattacaatcaagtatagatttacaattttatcaaatgcttttggacatcttacaattttcttctttgaaatattgatgatttgacatcatggtatgttgcttttaattaatacatgaggaagtttcccatcttttcctgtgttctagagtacttcttacagcattcaaataatctgttcttttaaaaattattacaaaatatattatctattcttcaaatgttgggaaaccttatatatctgttagcttttaaaaataatcaattacttactccccccagtgctccctgcactccagcaaagctgttttgcagtgattgatccagttaggtctcttatttaaa

SEQ ID NO: 384991 - DNA, 277 bp, Homo sapiens
gacaggtgtaatctaagcttaaataaaccccccggaggctgcacaatttcttggcatctctcccctgccctctccatccgcatattcattttggagtttggagaagtatctagaatcttctcccaccccaaaatgcccagcagagcccccccccccccccccgccgcccccgcaccccttggagctgcggcttgctgaatcgttgagatgtctgacactgtcggggttccctacctagtgcttcaaccagatcacctcacttttgagtttccttcct

SEQ ID NO: 384992 - DNA, 339 bp, Homo sapiens
ctcccgtgtgccctcctcctcttatgccggcttgaaaatatttcctgtctctctatttctcaatccctggttgatgtcccaggattactcagcctctccggctttagtcactctcgctacccgctcccagggtccagggtggaggcagagggaggctgggagagaagctctactgccagctgggcctgggctggcctgggcatccctgaggttttaactgtctcctaaccacagaggatctcagggcctccagcagcgagccccaatgagtcaaactcttgtttcctcctctcccacccccgacccagtcagggcaggtgaggggtagaggtgatggca

SEQ ID NO: 384993 - DNA, 339 bp, Homo sapiens
gtttctcccttttctattctctgtgttggcggaaaatttaggttattttttaaatatttagaagaagccagtccaactgataaagccatccaggtctgaagttttgttgtagattttaaattatgagtcagtttccttaataaatgtcattctattcagatttttctacttctttatgttagcattgataaattgtatttttcaaggaatttatccattttgtcttatgatgtatgtataatctgctgttaaatgaatctgatgaattcttagttacagatattttagttttcaactgtagaatttttattaaaagtgtattctaattctcagatgaaa

SEQ ID NO: 384994 - DNA, 360 bp, Homo sapiens
gctttgtattcccctgttgatttctaacttgctctcattctctgcccttgctgtgctgattttaattaggtacccaggccgggtgcagtggctaacacctgtaatcccaacactttgggaggccgaggcaggtggatcacttgaactgtcaggagttcaagaccaacctggccaacatagtgaaaccctgtctctactaaaaatacaaaaattagctggatgtggtggcacacgcctgtaatcccagctactcgggaggctgaggcaggagaattgcttgagcctgggaggtagaggttgcaatgagccaagatcccatcactacactccagcctgggtgacagagcgagactccgtctc

SEQ ID NO: 384995 - DNA, 1515 bp, Homo sapiens
tggataaggcaactcagccaggacacagtgggattgaacctactgctggttggttcttgcagagaaccctcaccctgaacaggagctgggtcaagtcagagaatggaatcagtttcaaggaggagtgatggattcccaatgctcctggttggggatctgagcctctcagaggtgaaagggactttaatgctcatattcaacattctcatttggtagatgaggaaacaggggcccaaggtcacatagcaagtaagaaacattagggtttctgattctgagatggcttacagttaagtgacttactctacaaactcatttcactcagctgggctgttttcatctttctgtaaaggtaggtaccaagatctaaacccatggctccctgtttcaagggcttccaacaaaaggccagcaaagggttggccccagcactggctctcctgctgctgacatctccaaaggcatctctgctctctcctacctgacagcagccccattcccaaactccctgtcccagtctctagaagatcacttcacacagccaaaggagactcatattttccagtgtagaaacacggacccaggctgaagtgttggggttttctcaaagtgcttttattgtttaatgcaaagtcagcctttgcctacttcctgggtgtcttgtagccggctcagggcctcccccatcccatggtggttctgggccaaggacacatccatgcatgtgggtttccaactctgcagctcccctccatttacccggtacctccaaacttgacgagcagacctggagcccatctgtgtgtaaaaacccctcagggactaggggactaactttgacatattgcacatgcactagttttcttcttccccattggtaaggatgacagggtccctcttctttggccagggaaaccatgacattcactttctttgctgttgtacatccaatttctttccttaatcatatctgatgctgggatgtgggtaaccccaaactgaaggcagctgctaaatctcaaatgctaaaaaaatactgcaattttgacatcagtgagtcagatcaatacatcctctggggctgattttgcttcacagttaggatgagccatctcttaagctgcaggctcaaatgggattaactgaactctatacctgggatgggccatggactgagctgtccatgcagaaggaccaggctgtccatgccttccctgcccttttactcaccactgcacagcagccccagtgggcctactgcacatgtctaggagaaatcactctaagaaaaccaacaggaacaggctttaggcaacaagagacgtctcactgcatctcctcccacgtcagaacttgagtactgggtctttgcagctcagagcattcctcccttccttctcctgcccgcaaagccctgcctctctcctgagtacatatgacactccatgctgcaagatttcaaggcagatgcaggtatcttatgggtgctttttgactcaaagcagctttttggtt

SEQ ID NO: 384996 - DNA, 1391 bp, Homo sapiens
tggataaggcaactcagccaggacacagtgggattgaacctactgctggttggttcttgcagagaaccctcaccctgaacaggagctgggtcaagtcagagaatggaatcagtttcaaggaggagtgatggattcccaatgctcctggttggggatctgagcctctcagaggtgaaagggactttaatgctcatattcaacattctcatttggtagatgaggaaacaggggcccaaggtcacatagcaagtaagaaacattagggtttctgattctgagatggcttacagttaagtgacttactctacaaactcatttcactcagctgggctgttttcatctttctgtaaaggtaggtaccaagatctaaacccatggctccctgtttcaagggcttccaacaaaaggccagcaaagggttggccccagcactggctctcctgctgctgacatctccaaaggcatctctgctctctcctacctgacagcagccccattcccaaactccctgtcccagtctctagaagatcacttcacacagccaaaggagactcatattttccagtgtagaaacacggacccaggctgaagtgttggggttttctcaaagtgcttttattgtttaatgcaaagtcagcctttgcctacttcctgggtgtcttgtagccggctcagggcctcccccatcccatggtggttctgggccaaggacacatccatgcatgtgggtttccaactctgcagctcccctccatttacccggtacctccaaacttgacgagcagacctggagcccatctgtgtgtaaaaacccctcagggactaggggactaactttgacatattgcacatgcactagttttcttcttccccattggtaaggatgacagggtccctcttctttggccagggaaaccatgacattcactttctttgctgttgtacatccaatttctttccttaatcatatctgatgctgggatgtgggtaaccccaaactgaaggcagctgctaaatctcaaatgctaaaaaaatactgcaattttgacatcagtgagtcagatcaatacatcctctggggctgattttgcttcacagttaggatgagccatctcttaagctgcaggctcaaatgggattaactgaactctatacctgggatgggccatggactgagctgtccatgcagaaggaccaggctgtccatgccttccctgcccttttactcaccactgcacagcagccccagtgggcctactgcacatgtctaggagaaatcactctaagaaaaccaacaggaacaggctttaggcaactacagaagagcctcgaaaaaggtcctaatacagagagggaatgcagaagaatgggagggagttatatgccgctga

SEQ ID NO: 384997 - DNA, 423 bp, Homo sapiens
ttgaggtggagtttcactctgtcacccaggctggagtacagtggcgtgttcttggctcactgcaacctccgcctcctgggttgaagtgagtctcctgcctcagcctcctgagtaggtgggactacaggtgtgtgccaccatgcctggctaatttttgtatttttaatagagacggggtttcaccatgttagccaggctggtctcgaattcctgacctcaggcaatctgccggcctcagcctcccaaagtgctgagattacaggcatgagccactgtgcctggccgacaatattcttaagtataaagaacatataatagttggaaaaatctatgagcagaaatattttaggggatattttgttatatattcagtatttctataaatgttttcaaaatatacaaaattttgaatgaaaaaaaaaa

SEQ ID NO: 384998 - DNA, 445 bp, Homo sapiens
ggcttgagcacctgggcaccctttccctcacctcacctggggagaagaggtcgtcctgaaggtgatgaacaggagggtactggccagcgaggggtcagcgtggcaaggtgtgataactgctggcactatctgtgcatatggcctcttcatccttggctcttacggccctacctttccagcctgctatctgcccacagaagagggtgggacccaagagtggcgttaaagagtctattccaactccatcaactgcaactgcaggcttgtctctgctttcggttattacctgcgtgacagcaattgtcctcacggccttttcggggactgctgcaggtgaacctgcacgtggagaatgcgcagaatgtgggccttgggtcctgggcagggtctaaggataggcatgcattagtccttggcgccgtcaacgccggatcccaggcaggag

SEQ ID NO: 384999 - DNA, 227 bp, Homo sapiens
attttgtgacttatctccacttcatgttacattgcttactaacaaattcggttttgtttttttgagagagggtctcctgtcacctagctggagtgcagtggcatgatcatggctcactgcagcctcaacctcttgtgctcatgcgatcctccctcctgccccagcttttcatgttattaggactataggcacatgccaccatgcctaatattaaaaactttttagag

SEQ ID NO: 385000 - DNA, 262 bp, Homo sapiens
tggaagtgttacttgctttgaagtttactttgtcagattagtatagccacttcagctttctttttcttggtttttgcatgaaatatgtttttctatcctttactttttacacacacacacacacacacacacatatttaagcagatttttcatacatagtatatacatatatttttatccaatctgacaatctgtgctgatttggtatatttagaccatttacatttaaagtgattacccatatggttgaatataggtgaac

SEQ ID NO: 385001 - DNA, 754 bp, Homo sapiens
aaagattttaagtttatgatccctgcagccatcaattatctttaggcacccaactattaataaaatgacagtgtgatgtcattgtccacaaagaataagtcatctttcaaatgccttttctaattgttaagtgctaatgccttgattactgtcagagtaatttaaattttctataagattatcaaaggttttgtgactgttaactccccacaaaactaaaatctagccaatcttaggcccagattacagatagggaatgcatttggaacagtcacttgctgtactgtggttgttgggggaaggcaggaggagatttgcctgataaaataagtgggaattggaggggagaaatgtctaaaggcagcgatggggatcctgtggaggaggaatggagccaggaataatagaaaggggaactcctggggaagggagctctgcatgctggctgctctgtggcaggcctgactggcaagcccttgggtgaagggagaaaatttgtaccctgaagaggtgaaagagcatagcatttgaaattggaaaacatgacattttgaccttagtccaaactgttaacccttctgggccttaggttttacatctgtaaattcaaaatgctagtccttgcctatctgaggggatgggattattgtaaggctcagatgtgttcatggacactgaaaagagttgtggaattgttacctggtatctggttatgtgagccaggggtctccacctggactcatttaaaaaaaaa

SEQ ID NO: 385002 - DNA, 370 bp, Homo sapiens
tcctgtctcaaaacaacaacaacaaaaaccctcattgtgatgtagagtaagtaagaagctcatccgctgacctcttcactttgaggattctccctgtagagtaagcagcctgacagctgctgaacaggttactagagagcattctcttagcaccaccacaaaaacacttggaatgcaaagcagcatttaagcaacattcatacgcagaagttaatctgaaacacacatgggtagcctttctccaaactctgcattatgcaataacagcattccctccaaactagtcagtcagtcccaggactcaaccagttttatgcttttactgtttttaaaaatgagtaactatgctactgagaggatgctctcaatc

SEQ ID NO: 385003 - DNA, 913 bp, Homo sapiens
  misc_feature (742)..(742): n is a, c, g, or t
  misc_feature (746)..(746): n is a, c, g, or t
  misc_feature (764)..(764): n is a, c, g, or t
cggacgcgtgggtcgacccacgcgtccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaaccccttgttaatnggtngcaagagcgtggtgaagntttcccagcggaaggacatgcagtggcttggccagtggggaaaggtagccgcggttttattttcccgggaagaaaggtgcatgaatttggaattggggaattaccaaaagttagaaaatgaattgcgggaaagaagatttttcacacgc

SEQ ID NO: 385004 - DNA, 683 bp, Homo sapiens
tatactaaaatggaacgatacagagaagattagcatggcccctgcgcaaggatgacacgcaaattcgtgaagcgttccatatttgtgaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385005 - DNA, 488 bp, Homo sapiens
gtctagaggatcccgacatttccacgagtcaccactttatgaatctgtatgccatatgactcgtggaaatgtccacgtggacatttccacgagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385006 - DNA, 1645 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385007 - DNA, 1724 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactac

SEQ ID NO: 385008 - DNA, 2031 bp, Homo sapiens
  misc_feature (1657)..(1657): n is a, c, g, or t
  misc_feature (1659)..(1659): n is a, c, g, or t
  misc_feature (1675)..(1675): n is a, c, g, or t
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacaaaaaaaaaaaananaaaaaaaaaaaaaaanaaaaaaaaaaaaaaaaaaaaaaaaaaaaaaaaaaaaaaaaaaacaacacgaggggggaggccacagaaacaacacccgcaaggaggggagcacaaacagaagcgacgcacacaccattttgaacaaaaagagcacaccaacaagcaagagagtaatacagacgaaaggagagagaacaggctgtatttaacaacaaacgattgtgctgtaggcggaaaaaaaaatgagagaacagtaagaaaaatttctggaggaacggcaaacactaatattatggagggaggggacaacaacagtggcgaacaaaaatacttaagaaataatatagaaacctgtgaggaaaataatagcatttc

SEQ ID NO: 385009 - DNA, 1632 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagctcgcccctgagttagcagctcgcccctgagttagcagctcgcccctgagttagcagctcgcccctgagttagcagctcgcccctgagttgt

SEQ ID NO: 385010 - DNA, 1359 bp, Homo sapiens
  misc_feature (1188)..(1188): n is a, c, g, or t
  misc_feature (1192)..(1192): n is a, c, g, or t
  misc_feature (1210)..(1210): n is a, c, g, or t
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaaccccttgttaatnggtngcaagagcgtggtgaagntttcccagcggaaggacatgcagtggcttggccagtggggaaaggtagccgcggttttattttcccgggaagaaaggtgcatgaatttggaattggggaattaccaaaagttagaaaatgaattgcgggaaagaagatttttcacacgc

SEQ ID NO: 385011 - DNA, 1227 bp, Homo sapiens
tgagaggcgagtggtcagtgcagttcggaagggagcgtggggtcttgagggacgggaaagaggggtacataggcttagtgatagagcctggcgggggtaaggaaagggcaaaccagatttcatttgactttgctgaccttcgccttgtctatctgcagccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385012 - DNA, 1167 bp, Homo sapiens
  misc_feature (27)..(27): n is a, c, g, or t
  misc_feature (68)..(68): n is a, c, g, or t
tttaaaaaagcagctgtaccgtcggantcccggatggacgctaaatgcacctgaatttcgtgacatgntgtcccggtgtactttccgcccctccacagcgccccctctctgaaaatgcagccttcctaggtccagggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385013 - DNA, 1514 bp, Homo sapiens
  misc_feature (27)..(28): n is a, c, g, or t
  misc_feature (40)..(40): n is a, c, g, or t
  misc_feature (46)..(47): n is a, c, g, or t
  misc_feature (73)..(73): n is a, c, g, or t
  misc_feature (78)..(78): n is a, c, g, or t
  misc_feature (110)..(110): n is a, c, g, or t
  misc_feature (117)..(117): n is a, c, g, or t
  misc_feature (121)..(121): n is a, c, g, or t
  misc_feature (128)..(128): n is a, c, g, or t
  misc_feature (187)..(187): n is a, c, g, or t
  misc_feature (193)..(193): n is a, c, g, or t
  misc_feature (195)..(195): n is a, c, g, or t
  misc_feature (246)..(246): n is a, c, g, or t
  misc_feature (252)..(252): n is a, c, g, or t
  misc_feature (356)..(356): n is a, c, g, or t
  misc_feature (382)..(382): n is a, c, g, or t
tgacacccacatagcactgctactagnnacatcactcatnaggggnncgaatctgcgaagtgcttcttaccgncgtgntgtgctgtgcccgaccattacactctccgctnattagtncatnacactanactaccagcaacgcttactagtgactacatgcgccccaacactctgcgtcctgatgccntctganantctctcgtctgcatgagcctgtgaatctttgacgctgtcgtgctcgcctgnagcacnagtgcgtcctcgtatacgggcgtggtacacgagcggcaactgccttcagacgcattctcgcatcacccgtgcggaccttctctagcttcgaatcgctattagcnatcgtccgcggttcgcttgcgtatcntctatctctcgctctgccaggcccacctgctaggcccgcctcgtcgtcttggatatgacatcgcagaccgtctctctaaggacgcacgtgggtatattggcgacgcgcagactacagggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385014 - DNA, 1499 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccagggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385015 - DNA, 1687 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaccctgattgggtccacggagcagacccttctacactgggtggggaacaccttgggcaaaccttccacacgcggagaaggggaccctggctccgggttgtggaccacaagtctgacacaggtccaccgcctgtaagtttctcccgagagaactccggcataaacctacaaatgcggtgatagcatacttgacaacgcatcgaaaaatcgcgattttgtgtggtcaatagtacgtgactatctacatctctctcaatccccacaacactatgcaagcgcgaacgaaaagaggacgaggcaaccgcacgtcacagctagcgatccgatcaggtcctgagatcgacagcggcacaaggcagcaaggagtagcgtcaccctcggagtcacgcacgggagcagagtaacccacggccgaggacggcgccggacaagatagagacacgaccatcgggacgcgagcacggcacagcggcgtagagacgcaagcaggccgcggaccgacagcaacccacgacccagaccaagacgcgcccagacccg

SEQ ID NO: 385016 - DNA, 1690 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttctcagttttaggataaagaaactggaagaattcctcaggatcagtccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385017 - DNA, 1591 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385018 - DNA, 708 bp, Homo sapiens
  misc_feature (38)..(38): n is a, c, g, or t
  misc_feature (41)..(41): n is a, c, g, or t
ggtaactcatggcaaactgcccactgagagcgagcggntcntccacactccgatgcattgatacggagagtcacacaggcactggttcagaagcgccttactgatgtgcaagaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385019 - DNA, 474 bp, Homo sapiens
atagaagcagcccaatcggccatcagtagatgaatggataagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385020 - DNA, 997 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385021 - DNA, 347 bp, Homo sapiens
tgcaaggctgatagaagggattccagtattgggtagaaggttaaatgtctgtgattaattctttgctgttgtcacagctgattactggaccctaaccttcccattcccagtccattctctttccattatgagagttagaaaactgcctcaattatcaaccctatttattgtttctgctcattattcatacactgtattctccttaaagaaacaggctttacatttgtacaattactacctgtagggtattgcaggcaacaaggacctttcatacagggcagccacaccttgtccctgtaccacctcttcctgaatacggaggaaaagttcgttatggactgatccct

SEQ ID NO: 385022 - DNA, 1211 bp, Homo sapiens
cggacgcgtgggtcgacccacgcgtggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaccctgattgggtccacggagcagacccttctacactgggtggggaacaccttgggcaaaccttccacacgcggagaaggggaccctggctccgggttgtggaccacaagtctgacacaggtccaccgcctgtaagtttctcccgagagaactccggcataaacctacaaatgcggtgatagcatacttgacaacgcatcgaaaaatcgcgattttgtgtggtcaatagtacgtgactatctacatctctctcaatccccacaacactatgcaagcgcgaacgaaaagaggacgaggcaaccgcacgtcacagctagcgatccgatcaggtcctgagatcgacagcggcacaaggcagcaaggagtagcgtcaccctcggagtcacgcacgggagcagagtaacccacggccgaggacggcgccggacaagatagagacacgaccatcgggacgcgagcacggcacagcggcgtagagacgcaagcaggccgcggaccgacagcaacccacgacccagaccaagacgcgcccagacccg

SEQ ID NO: 385023 - DNA, 1544 bp, Homo sapiens
accgcacagaacagcgttccggccgggtctggatctgagctcaggaacgcggggcagggctggggacagctcggtgacgcgacccaggactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385024 - DNA, 2216 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaaccagccaggccaacacagtgaaaccctgtctctactaaaaatacaaaaggttagccgggcatggtggcaggcgcctgtaatcccagctactcaggaggctgaggcaggagaattgcttgaacgcaggaggcaaaggttgcagtgagctgagatcacgccactgcactccagcctgggcaacagacctcgactccatctagaa

SEQ ID NO: 385025 - DNA, 1683 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacaaaaaaagggggggcgcaaaaatacccccggggccagtt

SEQ ID NO: 385026 - DNA, 1382 bp, Homo sapiens
  misc_feature (1230)..(1230): n is a, c, g, or t
  misc_feature (1232)..(1232): n is a, c, g, or t
  misc_feature (1243)..(1243): n is a, c, g, or t
  misc_feature (1281)..(1281): n is a, c, g, or t
  misc_feature (1295)..(1296): n is a, c, g, or t
  misc_feature (1302)..(1302): n is a, c, g, or t
  misc_feature (1305)..(1305): n is a, c, g, or t
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcagnangggacatgccntgctgggcccaagtgtggaaaggccgccccgttttatntttccctggactanngctgcnagnacatttgaacttggggggcgcgaaacccccaaagggtttgaacccgagagacctcggagaaaacacacaatcccaac

SEQ ID NO: 385027 - DNA, 1198 bp, Homo sapiens
ggccgtgagcgatgcttcaatcgtggttctcccagatctcaagatggctaacaggagggacgataactagagctgcagcgagttggataatctggccgtggggcgatcattagcgaggacccctgcttctgcacagaatgcaggaaccttacacatagagtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385028 - DNA, 1462 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcgggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaacttgcccaactagaagaggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaaca

SEQ ID NO: 385029 - DNA, 1273 bp, Homo sapiens
ggccctgggccggggtaagggagctcccaggcccgggatctcggctcaccggaccggtaccgcgcagcctccaactgccgttccatgcaggcgggcgcatttgggggaagattccactcccgggccgccgggggcactagggggggtggggtttccttccgcatctccacggttccaactccaacctagactcaaactggacgccggccggagactccgctccggcagcaaaccccacgtggtgcacctctgagcctccgcccctctcccgagggaaccgcaactctacttctcgcgagaattgcttctatggctccatcctgctttccggctgtcgccctcatgcgataggctctcagcgttacttgactcttctcgcgataattttttttaaaaatctcccaaggaaagttgaaggaagagtacaaaattttcatctcgcgagacttgtgagcggccatcttggttctgccctgacagattctcctatcggggtcacagggacgctaagattgctacctggactttcgttgaccatgctgtcccgggtggtactttccgccgccgccacagcggccccctctctgaagaatgcagccttcctaggtccaggggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgagcaaaaactcactcatgatagaagaaacgcaaatttaaaataccaatgatatcacttttcacccatcaggttggcaaagatcatgtaatttaatgtgctgacaaaattaaggggaaagtgaaactgccgtaccagtatctaccacaagtaaaccacacatattctttaacctagtaattctaattctacttgtaagtaagaatttatcatagctacacaaaagtttcacacaaggatgaaatgaatgtgttagaagttacttattacagcattgtttgaccagaaaagactcggggggccaggagtggtggctcatgcctgtaatcccagcacactgggaggccgaggtgg

SEQ ID NO: 385030 - DNA, 628 bp, Homo sapiens
gtgttactgggctgaaagaccacacccaaaacagtgtctggtatctaatctgtgtaaataagtgttactgggctggaccaaacaattttgaggtagtcacaattcagttgttaggattacaggcatgagtttttccaatagattttagttataagacaactaagcttttattaaaattttattattcttctaaacaccatcttgcagcaactgaatgagataggtactgatattatccttgttctatggacaaaaaagctaaggtttaaagatattaagtagtttgtctaagtttacattatcagtgagcaattgagccagattttgaatatggccagtcttacactagcatctagagtcttaaccactatgttgtttaacagcattacctaatgcattatttcctttacagaaaggcaaacttttacatggataggacacacaattgtacatttcagatagctcatatatgctaaaagcttactgaacaagtatttctgtattgttatctttgactttctatatcattgttcttactgtgaatcccacgttactgagcacaaagttgacagtaatacatattaatagctcacctctttttaattaaaattcatcttttcttcatcgt

SEQ ID NO: 385031 - DNA, 285 bp, Homo sapiens
taaaacataatccctgttcttaagttgttttctcttaatccaaaggattgaaataaagtcaagtgatcaaggtactgggttggggaggcatgaaataaggtgtgaaaggacgtatggcagacatttgggtcttattctttatagcactttttttagtaatcactggcaaattgttctcctacccagattgccttcccctgtctttgtcagctcttagtattgtcaacctatcttgtcttgggtttaataaaatattcatctaataaatatgtgtgttaaactctt

SEQ ID NO: 385032 - DNA, 449 bp, Homo sapiens
gactatattttctaattgttctaagataaacgtattgtttttaaatataacaaattattttttaaaaatattttacaactagaaaacaataaaaagttatatattcttaaaagattttctaaaatggtaatttaaattactcctcctcaaaaaatttaagttacattagcaaaacttgacaaatgataaaaaaaaaaattaatgtcattagagcagtgttcattaattgcttactaacattcagtcagtcagtacctctggataggagaattgctagaacccaggcgatggaggttgcagtgagccgagatcacgccactgcactccagcctgggcgacacagtgagactctgtctcaaaataaataaataaataaacaaacaaaaataaaagaagtataccaataaagtacttttacacaaaactaaacaaaacaagcagaccaaaaa

SEQ ID NO: 385033 - DNA, 553 bp, Homo sapiens
tatgcgtgagttgcacgcctgagtgcctctatgggttttgtggctcgtggcttttatgaagggaccagaatgttaggaactctggagttgggaattgctgcaggagaaccgtgttccgcatttcgttcttctagagcagaggttggtaaagcacggcccatgggtcaaatctggtccaccatctgcctctgtcagactttcccgggcataggcagttggtttacatactggctgtggctgctttcacaccaccacagcagcgagtggttgcgacagacgtcgtaaaacccgtaaagcccgagatatctgccactgggctctttacagaaaatgtttgccgacccctgttcggagcaagctttgtctaaaggactttatttcatttagtgacagtgagataatttattgctgcaaagaacttatagccaaatatgttctattttgtctggtgaaacagaatggcaagagctttttagatactttgaggtttgggaacagcaccgttgagggtgagaagttggttttgatggacttattccatgatgatgctgga

SEQ ID NO: 385034 - DNA, 683 bp, Homo sapiens
cacataatgtgccagtcatcactggtagcaaagatttacagaatgtcaatatcattccgtgcatcctctttgggcctgtcactagccagcttcctcgcatcttcaccaggatcggagaagactatgatgagcgtgtgctgccatccatcactactgagatcctcaagtcagtggtggctcgctttgatgctggagaactaatcacccagagagaactggtctccaggcaggtgagcgacgaccttatggagcgagcagccacctttgggctcatcctggatgatgtgtctttgacacatctgaccttcaggaaggagttcacagaagcagctggaagccaaacaggtggctcagcaggatgcagagagggccagaactcactggccactgcaggggacggcctgatggagctgtgcaagctggaagctgcagaggacatcacgtaccagctctctcgctcttggaacatcaccaatctgccggcagggcagtccgtgctcctccagctgccccagtgagggcccaccctgcctgcacctccatgggccaactaggccacagccccagtgattcttaacactgccttccttctgcctccactccagaaatcactgtgaaatttcatgattggcttaaagtgaaggaaatacagataaaatcacttcagatctccaaaaaaaaaa

SEQ ID NO: 385035 - DNA, 653 bp, Homo sapiens
ggtcgacgtgagccaagatcgtgccactgcactccagcctggcaacagagccagactccatctcaaaaaaaaaaaaaaaatctcgttgaaaattacattattttctttttaacgtagagctgtcacacatttttttaaaaaaagagaccaaagcattagcatattgtaaatgtattttaatgccaggagatatacccatttccagaatggaaatgaatgttattttacatatttcttaattgtactgttttattgttctaaacaaatacgatttcaatattgctttgataacaagctgtagtcagttgtaattctaactgatggcaggcaaatgagtcagagaatctcttaatgttgtagcttaaattttctgaggaactaagccaaatgactagaaatataaagttttgtctccaaggaaatgtcaagtattaatatcacagtaagtgagaaaggaagtgcatggagatggaacaattgatgaaaaccaagtccccagttataaggagacaacagagcacttaagcaaagtatttggaacatgattatcactagggcattttaactgatccctgtgctgaaaggaagtagccttgtttggcaacccttctatatttgtacttgtgttttgttcttctcatgtcaatctacca

SEQ ID NO: 385036 - DNA, 337 bp, Homo sapiens
ctaatttagaactaggaagattatatttcaatgttaataaaatttagaagcatcgtgggccgttatcttttttatgaagtatcattgaactttgttatataaccaagtattcagtcatgtataatgaaatttagtcagtaatatgatcatagtatctgccttctcaaaatttgctcattcttttggaaagaatgagggatggagaatgatggaaagatttgtgtaatttaatgatggtggtgtggtgggggagtagacagatgcacatataaaggaataacactagcacactgaacatttactgtgcagtcactgttctaagaagtttcatgtattt

SEQ ID NO: 385037 - DNA, 369 bp, Homo sapiens
agactgacttaacaaataacgccagactatacattcattggagttttgaccctcttaaaattggcatgcaaaataatttcctgatggtagccacccacgtaagcttatggtttgatgaccatagcagcaccttctgttttggagatttttcttacttcctgaaaaatacagtatcccacggttctgaggcaggactatatgctcagaaatgacacaatgattatttgaatatattcagtggtagaaagtatctttttagtgttgaatgtttcagtaacagcaaaaaatcatttggaacttagcatgcgtgtaaagtaatgagacaaattgtcttttctggtattgggggcattttcaaaagagacttaa

SEQ ID NO: 385038 - DNA, 2607 bp, Homo sapiens
ccatgttggtcaggttggcctcgaactcctgatctcaggtgatccacctgcctcggcttctcaaagtgctgggattccaggcatgagccaccatgcctggccgcatgtgtcattttcttgggtgttatactgatcgtatatttgcaggtttgcttttgtgacagacttcttctgggggaaaaaaagtatccttctatctttttacttttgtccagttccaggtatccctgtttttttcttcactcttccttccttgttcatgggagtttttcttgaggacttcaagcccagcttcggagaatcctggttgtgtcatctcatctcctttctgctctcttctctacctagcctttccaccctcacacctcccggggtctgaaaatggaaagataagggtgtttccctgaaagttgctcttctgtgtggggatgacaggttctaaagactcttttctggtccctgccctcattgccatgattaatcagttaagtggcccgaggttttataacagcacagtcttaaaatgcttctcccaagtttaatttctctccatttgaccttttaaggatgtgaattggctttaagcagtagactccctttagtacggcgctgtgagcctctcagtgaatctgctacatccattccacccacgggtctggaaacttgtctgtttacctttccctaaaaacctaagatatatttttaagaagtgccttgtaacttttcatatagcctttcccctactttgggtagactgtttcttacaggaatttggtagatctttccaaagagaattctgtatctgtatttttaaagcataaatcctgtcaactttggaggagaactgatttggcttgagttttctcagacatgggaacttttgacctaagtttgtattttacattgttgaaagggaactccgggatcccagaaaacatatggactgcaattgggtaaagcttctgttccagaaatgcctcttctggacatttcatacaaatggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtacaattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcatctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatgtactgtcttttcacattcttgatgatagacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctctgatccattttgagttaatttttatgtgcgaggagggagtctaacttgattcttttacatgtggatatttagttgtcccaggaccatttgttgaattaagtgcccagaacaagtacatctatatatagagaaagtagattagtggttgtcagagactgtaagaagtggggaattggagagtgactgcccataggtacaggcatgctttttggcattatgaaaatattctggaattaggtagtggtgatggttgcagaacttttggaatatggtaaaagacactgaaatatatgcttaaaaatggtgatttttgtgatatatgaattatactatagaactaataataacagtaataaagcaaggtgtctttccacatctccatgccttgtattttcattaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcactccagcctgggtgacagaacaagaccctgtctcaaaaa

SEQ ID NO: 385039 - DNA, 964 bp, Homo sapiens
ggacccggtgaccagggccatctcggactacacgcagacgctgtccaagcggcccgacatccccaccttcgagagcttgacgttcaaaaacaggacagcgggcctcatcgacacgtcgtggagcgccatccagatcggcatctacgccaagcacctggagcactggctgcgccacttccccatccgccagatgctcttcgtgagcggcgagcggctcatcagcgacccggccggggagctgggccgcgtgcaagacttcctgggcctcaagaggatcatcacggacaagcacttctacttcaacaagaccaagggcttcccctgcctgaagaaggcggagggcagcagccggccccattgcctgggcaagaccaagggcaggacccatcctgagatcgaccgcgaggtggtgcgcaggctgcgcgagttctaccggcctttcaacctcaagttctaccagatgaccgggcacgactttggctgggattgagcagacccgggctatgtaccttacccacgtggcttatctattgacagagattatatgtatgtaaaatgtacagaaatctattttataataatttatttttaattcataagcaattaattcactaagctgcctagccacactctttagagagttagcttcataatctgttaacattccaaagtgtttaactctagtatttcgttctcttcttcacaattgatggtgcttctattttttcttctcccctacctgttatatttaaaacaaagaaaagcacaacttgagatttttgttgttacgggtattcagccttcagtcaccgtctgagttctccagttgctgcctccttgtcttgtcttgggtctcccattccagcttccctgtctcttcctgcctgtgtacctcgtaggaacgctgagctgcctcaacagggctgtattctgaagggcaggcctcatgcagcagcctccttgc

SEQ ID NO: 385040 - DNA, 411 bp, Homo sapiens
accaatggggcctcctctctgcagcaaccccttccactcccatattacatgttcattcatctacatcattcatcatttttcttgactacaattctatttttcttgtctaacccatcacacaatttaaaatcgctttcctatattaattccccaactacctataaataaagaagctttagtccccaaacagctaaatggtaaagtctcctgccttctcctctctgcttccagaaagcctaaagtcagaccgtcaaccctcacatagggaatttgagggtcaaactctaaaaatcctgaatctccagagaaaaagaaccaaacattgacatttttgaggagccatccccttccacacataacagattcagaagaaaaatctggcttgcaacttggtcactccatagtgagacc

SEQ ID NO: 385041 - DNA, 3800 bp, Homo sapiens
  misc_feature (3756)..(3756): n is a, c, g, or t
  misc_feature (3789)..(3791): n is a, c, g, or t
gaggaaaggctgtctccacccacctctcgcactctcccttctcctttataaaggccggaacagctgaaagggtggcaacttctcctcctgcggccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcaggcgggcagacggaccgacggactcgcgccgcgtccacctgtcggccgggcccagccgagcgcgcagcgggcacgccgcgcgcgcggagcagccgtgcccgccgcccgggcccgccgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctgcactcgggctcgggatccgcccaggtagcggcctcggacccaggtcctgcgcccaggtcctcccctgccccccagcgacggagccggggccgggggcggcggcgccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaatgaatccgccggaggtctgtctgttggcatcgtgcgtgacaattaacctttctgccttggcaggatgtgccgacagcttgcggcgtgttcctctcactctgggagcctcaggcgtgatctcacacactggcgtgcacatacacacacacacacatacatgctcacacatgcgtgcacatacacgcaggcctgcaacttgggggaggcctctgtctggcgggaagaagagacacacaggctactctgttggtcttggtcctggcacagctcctgacacgtgnacttgtgcgtgtctctggcagtgacgagagatnnntttctgcag

SEQ ID NO: 385042 - DNA, 407 bp, Homo sapiens
  misc_feature (363)..(363): n is a, c, g, or t
  misc_feature (396)..(398): n is a, c, g, or t
ctagtgctgttaggcccgcggcccgtaaaaaaaaaaaaaaaaaaaaaaaaaaaaaaaaaaataaccacaaaacaaaaccaaatgaatccgccggaggtctgtctgttggcatcgtgcgtgacaattaacctttctgccttggcaggatgtgccgacagcttgcggcgtgttcctctcactctgggagcctcaggcgtgatctcacacactggcgtgcacatacacacacacacacatacatgctcacacatgcgtgcacatacacgcaggcctgcaacttgggggaggcctctgtctggcgggaagaagagacacacaggctactctgttggtcttggtcctggcacagctcctgacacgtgnacttgtgcgtgtctctggcagtgacgagagatnnntttctgcag

SEQ ID NO: 385043 - DNA, 3647 bp, Homo sapiens
gaggaaaggctgtctccacccacctctcgcactctcccttctcctttataaaggccggaacagctgaaagggtggcaacttctcctcctgcggccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcaggcgggcagacggaccgacggactcgcgccgcgtccacctgtcggccgggcccagccgagcgcgcagcgggcacgccgcgcgcgcggagcagccgtgcccgccgcccgggcccgccgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctgcactcgggctcgggatccgcccaggtagcggcctcggacccaggtcctgcgcccaggtcctcccctgccccccagcgacggagccggggccgggggcggcggcgccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaaaaaaaaaaaaaacttctcctcctgcagccgggagcggccggcctgcctccctgcgcacccgcagcctcccccgctgcctccctagggctcccctccggccgccagcgcccatttttcattccctagatagagatactttgcgcgcacacacatacatacgcgcgcaaaaagg

SEQ ID NO: 385044 - DNA, 2600 bp, Homo sapiens
ccccagctgtcttatggctatgatgagaaatcaaccggaggaatttccgtgcctggccccatgggtccctctggtcctcgtggtctccctggcccccctggtgcacctggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaaaaaaaaaaaaaacttctcctcctgcagccgggagcggccggcctgcctccctgcgcacccgcagcctcccccgctgcctccctagggctcccctccggccgccagcgcccatttttcattccctagatagagatactttgcgcgcacacacatacatacgcgcgcaaaaagg

SEQ ID NO: 385045 - DNA, 509 bp, Homo sapiens
tgtgccagcagagggaagcggacatttactaagcatttacaacatgccccacactctgaattttctcacttgaaactacagtggttcttgggtgtagatctcatggtcccattttcagatggggaaacacaggcttagagtggctcagccatctgcccaagtcccatggctaatgacagccaggacttgaaacctgaaccctggggttgaagggcgtgagaaagagcagtcccggaggcacccgctgagctcccctgccaagtggggggactctggacaggcctacgctcctgacccaggtttcgtctcctcccaggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagct

SEQ ID NO: 385046 - DNA, 1377 bp, Homo sapiens
gaggaaaggctgtctccacccacctctcgcactctcccttctcctttataaaggccggaacagctgaaagggtggcaacttctcctcctgcggccgggagcggcctgcctgcctccctgcgcacccgcagcctcccccgctgcctccctagggctcccctccggccgccagcgcccatttttcattccctagatagagatactttgcgcgcacacacatacatacgcgcgcaaaaaggaaaaaaaaaaaaaaaagcccaccctccagcctcgctgcaaagagaaaaccggagcagccgcagctcgcagctcgcagctcgcagcccgcagcccgcagaggacgcccagagcggcgagcaggcgggcagacggaccgacggactcgcgccgcgtccacctgtcggccgggcccagccgagcgcgcagcgggcacgccgcgcgcgcggagcagccgtgcccgccgcccgggcccgccgccagggcgcacacgctcccgcccccctacccggcccgggcgggagtttgcacctctccctgcccgggtgctcgagctgccgttgcaaagccaactttggaaaaagttttttgggggagacttgggccttgaggtgcccagctccgcgctttccgattttgggggcctttccagaaaatgttgcaaaaaagctaagccggcgggcagaggaaaacgcctgtagccggcgagtgaagacgaaccatcgactgccgtgttccttttcctcttggaggttggagtcccctgggcgcccccacacggctagacgcctcggctggttcgcgacgcagccccccggccgtggatgctgcactcgggctcgggatccgcccaggtagcggcctcggacccaggtcctgcgcccaggtcctcccctgccccccagcgacggagccggggccgggggcggcggcgccgggggccatgcgggtgagccgcggctgcagaggcctgagcgcctgatcgccgcggacccgagccgagcccacccccctccccagccccccaccctggccgcgggggcggcgcgctcgatctacgcgtccggggccccgcggggccgggcccggagtcggcatgaatcgctgctgggcgctcttcctgtctctctgctgctacctgcgtctggtcagcgccgagggggaccccattcccgaggagctttatgagatgctgagtgaccactcgatccgctcctttgatgatctccaacgcctgctgcacggagaccccggagaggaagatcgggccgagatgtacctgaacatgatcccgcaccaacctctggactcgagttgcagagcacgacttgactacagagaggtcacctgggtagccactgatcaacagatgacacgccga

SEQ ID NO: 385047 - DNA, 2578 bp, Homo sapiens
  misc_feature (16)..(16): n is a, c, g, or t
  misc_feature (18)..(18): n is a, c, g, or t
gtgtgtgtgtgtgtgngngcgcatctgagagagagagagagagagactgactgagcaggaatggtgagatgtttatcatgggcctcggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaaaaaaaaaaaaaacttctcctcctgcagccgggagcggccggcctgcctccctgcgcacccgcagcctcccccgctgcctccctagggctcccctccggccgccagcgcccatttttcattccctagatagagatactttgcgcgcacacacatacatacgcgcgcaaaaagg

SEQ ID NO: 385048 - DNA, 2632 bp, Homo sapiens
acaagggtgagacaggcgaacagggcgacagaggcataaagggtcaccgtggcttctctggcctccagggtccccctggccctcctggctctcctggtgaacaaggtccctctggagcctctggtcctgctggtccccgaggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaaaaaaaaaaaaaacttctcctcctgcagccgggagcggccggcctgcctccctgcgcacccgcagcctcccccgctgcctccctagggctcccctccggccgccagcgcccatttttcattccctagatagagatactttgcgcgcacacacatacatacgcgcgcaaaaagg

SEQ ID NO: 385049 - DNA, 2619 bp, Homo sapiens
agggcctaagggtgacagaggtgatgctggtcccaaaggtgctgatggctctcctggcaaagatggcgtccgtggtctgaccggccccattggtcctcctggccctgctggtgcccctggtgacaagggggaccccattcccgaggagctttatgagatgctgagtgaccactcgatccgctcctttgatgatctccaacgcctgctgcacggagaccccggagaggaagatggggccgagttggacctgaacatgacccgctcccactctggaggcgagctggagagcttggctcgtggaagaaggagcctgggttccctgaccattgctgagccggccatgatcgccgagtgcaagacgcgcaccgaggtgttcgagatctcccggcgcctcatagaccgcaccaacgccaacttcctggtgtggccgccctgtgtggaggtgcagcgctgctccggctgctgcaacaaccgcaacgtgcagtgccgccccacccaggtgcagctgcgacctgtccaggtgagaaagatcgagattgtgcggaagaagccaatctttaagaaggccacggtgacgctggaagaccacctggcatgcaagtgtgagacagtggcagctgcacggcctgtgacccgaagcccggggggttcccaggagcagcgagccaaaacgccccaaactcgggtgaccattcggacggtgcgagtccgccggccccccaagggcaagcaccggaaattcaagcacacgcatgacaagacggcactgaaggagacccttggagcctaggggcatcggcaggagagtgtgtgggcagggttatttaatatggtatttgctgtattgcccccatggggtccttggagtgataatattgtttccctcgtccgtctgtctcgatgcctgattcggacggccaatggtgcttcccccacccctccacgtgtccgtccacccttccatcagcgggtctcctcccagcggcctccggctcttgcccagcagctcaagaagaaaaagaaggactgaactccatcgccatcttcttcccttaactccaagaacttgggataagagtgtgagagagactgatggggtcgctctttgggggaaacgggctccttcccctgcacctggcctgggccacacctgagcgctgtggactgtcctgaggagccctgaggacctctcagcatagcctgcctgatccctgaacccctggccagctctgaggggaggcacctccaggcaggccaggctgcctcggactccatggctaagaccacagacgggcacacagactggagaaaacccctcccacggtgcccaaacaccagtcacctcgtctccctggtgcctctgtgcacagtggcttcttttcgttttcgttttgaagacgtggactcctcttggtgggtgtggccagcacaccaagtggctgggtgccctctcaggtgggttagagatggagtttgctgttgaggtggctgtagatggtgacctgggtatcccctgcctcctgccaccccttcctccccacactccactctgattcacctcttcctctggttcctttcatctctctacctccaccctgcattttcctcttgtcctggcccttcagtctgctccaccaaggggctcttgaaccccttattaaggccccagatgatcccagtcactcctctctagggcagaagactagaggccagggcagcaagggacctgctcatcatattccaacccagccacgactgccatgtaaggttgtgcagggtgtgtactgcacaaggacattgtatgcagggagcactgttcacatcatagataaagctgatttgtatatttattatgacaatttctggcagatgtaggtaaagaggaaaaggatccttttcctaattcacacaaagactccttgtggactggctgtgcccctgatgcagcctgtggcttggagtggccaaataggagggagactgtggtaggggcagggaggcaacactgctgtccacatgacctccatttcccaaagtcctctgctccagcaactgcccttccaggtgggtgtgggacacctgggagaaggtctccaagggagggtgcagccctcttgcccgcacccctccctgcttgcacacttccccatctttgatccttctgagctccacctctggtggctcctcctaggaaaccagctcgtgggctgggaatgggggagagaagggaaaagatccccaagaccccctggggtgggatctgagctcccacctcccttcccacctactgcactttcccccttcccgccttccaaaacctgcttccttcagtttgtaaagtcggtgattatatttttgggggctttccttttattttttaaatgtaaaatttatttatattccgtatttaaagttgtaaaaaaaaataaccacaaaacaaaaccaaaaaaaaaaaaaaacttctcctcctgcagccgggagcggccggcctgcctccctgcgcacccgcagcctcccccgctgcctccctagggctcccctccggccgccagcgcccatttttcattccctagatagagatactttgcgcgcacacacatacatacgcgcgcaaaaagg

SEQ ID NO: 385050 - DNA, 476 bp, Homo sapiens
  misc_feature (10)..(10): n is a, c, g, or t
  misc_feature (23)..(23): n is a, c, g, or t
  misc_feature (42)..(42): n is a, c, g, or t
  misc_feature (47)..(47): n is a, c, g, or t
  misc_feature (49)..(49): n is a, c, g, or t
gatttaaatnggcctcccctaangggaaatttggcccctcgnggccnanaattcggctcgagaacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385051 - DNA, 1910 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385052 - DNA, 2827 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaacctggcactgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttcc

SEQ ID NO: 385053 - DNA, 393 bp, Homo sapiens
ctcagttaatatttcaaaattgtaaccgtagcaaaactgcattggaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385054 - DNA, 657 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccggtgagtagctgccccatcttaagctctagagggacactcccgcccaggctctctagattcttgtggcgttgccaaccacgcctgagcacagtccactctccctgagcagagttcctggcttgagacagcaggagctgaaggacaagggcagaaaacaactgagggtgacacctagttccctctgctctggaacagggaagtggtggaactgatcactcacaccctcatcacgtccacatgcccgtttgtgagccaggggggtatcatgcaggcctatggagcagtgtagacactagggagcagagcactgcagcgtggtctggcaggaagtggggggcccagtatggttggctttgggttgaagggaagaggtcagcatttaagaaagccatcgtgtggccgggcgcggtggctcacccctgtaatcccagcactttgggaggccgaggcaggcggatcacgaggtcaggagaccgagaccatcctggctaacacggtgaaaccccgtctcca

SEQ ID NO: 385055 - DNA, 421 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagggaagctatatgactcagacatcgtccactgcagcagcagctctcattggtcaaagctagcaagcatgtctcaaggcatg

SEQ ID NO: 385056 - DNA, 1859 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaagcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385057 - DNA, 2367 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaataaaactagtttatctatagtagaagagttagagagttagtacatgaaagactagttgcgcaaagtgcgtttcacttctagcgagttgcttcccaaggtcgtaacattgtttaacgcatctaagctagcatgcaagtttaggacacacctgacaaattgtggcttgtggttcgtagccctccgagccaaccgatggccgctcagtccctcgtctaaccccatgatgcttctgggttttattgccattggtcctcccttgacgcttgggcatcccttgccgtttagacacgcggtggaaagacggttaggccatgtgacaacgataaccaaatccatagaccaggccccatatccctaaaggcaagagcccaaagagataaggccccagggtgaccaaaggaaccaaattcgttccaccgttccttttccgtggaaccaggtcgccattgtctagggtacccgcgcaagcccaagggtccccttggaacccggtatgggggccccccccg

SEQ ID NO: 385058 - DNA, 2348 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacaggtaggcagtaacatcccccccgacctcagggggctcagatatgtcataattgtaatacctttcctagacagggaagccccagccatccacacaggggtgctggagccaaagtatcagacacaaggtctcaccatctttcacctcatctggaacattaggtggttctgtccatctgccttctctggacaccaggttcttcccagctggggaaaggtgggctagctggaccccactgggccccaagatgacctttccctgcccccatctctgagcgtaatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385059 - DNA, 2114 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagagtatggctagggaaagcactggaggggatggagccaagcggggctgtgaagaggccagtgcctcctacccacccatggctcggccttggtgtggtgattgccatgggatagttggggtctggggtaaggggaacaaagtcagccttatcttcttggtcgagaatacttctgtacctgtcctttttttcttgcaccccaccctagccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385060 - DNA, 2285 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385061 - DNA, 2581 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgggctttttgtagaaagcacccgcaaggggagtgtagtgtccagagctaatagcatcggttccaccagtgcctcttctgtccccaacacaggtaggcagtaacatcccccccgacctcagggggctcagatatgtcataattgtaatacctttcctagacagggaagccccagccatccacacaggggtgctggagccaaagtatcagacacaaggtctcaccatatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385062 - DNA, 1611 bp, Homo sapiens
  misc_feature (1218)..(1218): n is a, c, g, or t
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttcccccaaaaaaaaaaaaaaaaaaaaaaaaaaaaaaaaaaaaaaaaaaaaaaaaaaaaaaaaaaaacaaaaacagaaaaattaacaaaaaggaggagggggggggccgagcagaataataattcctccccgggggggcgcacaccataattactaatcataacgaccgccagatttgttcangaacgaaggggccccctcaatgtaggaagaggtttattaattataacaagacaaggcgcaggggcggcgccgctaattaaacacatgctcgtctgcggagtagaaaaaaaccgcttgctcacgtgagggagacctttttgtgggagaagagacccccacaaatcatgcggggggggagggaaagaattgttgggggaaaccaaccaccctagcagagaggaaataatatagccgccgcagggaggtgtcattaaaaaaccatcaaggggtgagatcaatagggtgtaggtcacaacaccacgaccttatatatctgtctggatgcgtaataaaaaaaatgtcttgctcgaagagcaattaatatgtttagcgaaaaaatatttacaacgcggg

SEQ ID NO: 385063 - DNA, 1231 bp, Homo sapiens
  misc_feature (10)..(10): n is a, c, g, or t
  misc_feature (23)..(23): n is a, c, g, or t
  misc_feature (42)..(42): n is a, c, g, or t
  misc_feature (47)..(47): n is a, c, g, or t
  misc_feature (49)..(49): n is a, c, g, or t
gatttaaatnggcctcccctaangggaaatttggcccctcgnggccnanaattcggctcgagaacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaacctggcactgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttcc

SEQ ID NO: 385064 - DNA, 487 bp, Homo sapiens
ctgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttccagctcacctgctctttctcttctggagtcacatgattggtagctgctttaatgttcttcaatctctctctgtagccagcgcattccttctttaactcctggatttctttctgcatctctggtgtggtcagggcactagataattccttgagctctgaaaccacatccgcctggggtcacttgctacccctgaggaaggagttctgtctttcccagtgggtgctccctgag

SEQ ID NO: 385065 - DNA, 2665 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaacctggcactgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttcc

SEQ ID NO: 385066 - DNA, 2575 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaacctggcactgcctgtcagtttatgatattgtgtagcggctgatctggtgcctgccattttcaaaggcacctccagggcctgtctcggagctcccacacacttaccatcctcttcctcttcctccactccttacagtacttctgcctctctctgtacacctagaaggaaaaagcaagttcctctaactcctcagaaccacagcagccctctggggctcagccctgatgttcactctggacctgcacagcggtcctacagccttcc

SEQ ID NO: 385067 - DNA, 2479 bp, Homo sapiens
  misc_feature (2086)..(2086): n is a, c, g, or t
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttaaaaaaaaaaaaaaaaaaaaaaaaaaaaaaaaaaaaaaaaaaaaaaaaaaaaaaaaaaaaacaaaaacagaaaaattaacaaaaaggaggagggggggggccgagcagaataataattcctccccgggggggcgcacaccataattactaatcataacgaccgccagatttgttcangaacgaaggggccccctcaatgtaggaagaggtttattaattataacaagacaaggcgcaggggcggcgccgctaattaaacacatgctcgtctgcggagtagaaaaaaaccgcttgctcacgtgagggagacctttttgtgggagaagagacccccacaaatcatgcggggggggagggaaagaattgttgggggaaaccaaccaccctagcagagaggaaataatatagccgccgcagggaggtgtcattaaaaaaccatcaaggggtgagatcaatagggtgtaggtcacaacaccacgaccttatatatctgtctggatgcgtaataaaaaaaatgtcttgctcgaagagcaattaatatgtttagcgaaaaaatatttacaacgcggg

SEQ ID NO: 385068 - DNA, 1982 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggagtatgcctacagcgacaacagcctggaccccgatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385069 - DNA, 1861 bp, Homo sapiens
ccttcccgtgctctgtgccgcaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagggttaaagaacccatttcccctgctgtttccacagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385070 - DNA, 2390 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacaggtaggcagtaacatcccccccgacctcagggggctcagatatgtcataattgtaatacctttcctagacagggaagccccagccatccacacaggggtgctggagccaaagtatcagacacaaggtctcaccatctttcacctcatctggaacattaggtggttctgtccatctgccttctctggacaccaggttcttcccagctggggaaaggtgggctagctggaccccactgggccccaagatgacctttccctgcccccatctctgagcgtaatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagagtatggctagggaaagcactggaggggatggagccaagcggggctgtgaagaggccagtgcctcctacccacccatggctcggccttggtgtggtgattgccatgggatagttggggtctggggtaaggggaacaaagtcagccttatcttcttggtcgagaatacttctgtacctgtcctttttttcttgcaccccaccctagccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385071 - DNA, 1361 bp, Homo sapiens
atccgcttaagataaaatggggctgggaaaaaccaaacaccaagtagaaaccaactgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385072 - DNA, 1032 bp, Homo sapiens
cgccacccgcttcctcgccgcagggggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggactcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaagtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttccttta

SEQ ID NO: 385073 - DNA, 156 bp, Homo sapiens
atatttcaggcaaccagccataattcttacgatatactgccctccagtggactcctgtcagacataacctctgaaaattattttaaataacctttacctaagctatcttttaggtgtgatatttaatctttgacaaaaactttaaaaatcctcttg

SEQ ID NO: 385074 - DNA, 570 bp, Homo sapiens
ggaactcatattggtagagtgaccaggtaggagcttggtttaattactccacatcactaatctaccaattttcattgttttaatgtgacacttattacaaatgactttttcttttctcagtcttaggtaataatgtgtgggaatttctgactgagacaaacatctgatatttgtttgcatactgtaggtgtaaactgctggaaaaaaactggtattatttttaaaaagggttgcacagccaaatgttaaagctgaagaagtgacgttattttagaagtctttttttttttttttccttctctgcaatcagatttctcagcctggtacattatgaacagcttagtgctgttgagtaatttatatcaggatgattaggaaagcttttctctgcagattttaatttttcttaaattaaaccactggctcaaacagaattttccttgaacccaagttttcacattagagatttgcataacttttaataattcttatccattttccttttctatcccctcttacctataattctcagtctttattctttcaaaaaaggaatgaatctcatcttta

SEQ ID NO: 385075 - DNA, 620 bp, Homo sapiens
gcagcggccgcgtcgacgggcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccga

SEQ ID NO: 385076 - DNA, 1237 bp, Homo sapiens
tcttgagagtgggggctgcgagagggtggggccggccaccttgggaccctcgggcgtgtctccccgagtgggctgcggtcagaggagcgtgggccggggcctggcggtctcagagggccagggttggggggtgcgggtccgaccgtgggcgcccgacctggcgacaggagggggtgtccagcgaccccggggcgggagaactggcggctcccgaacgcgacctcacagcccgcgcgcagggccggctccggtgccgcagtgtcctccgggccctgcaggcccagctcttcccagccggggccgctgaaccctaagggccggggcgcgtggggaagcaggggcgggcgaccggggtgccagagttccgtgctcttccggagcgggggcctgtcccgaaactggcccgagggagggcccctgggtctgggaagagttggagggaggagctcatcagttgaaccgtccttgacctggtgtctgtttggaaagggatgcggcctaagtttaagctccctcccagccaagtgagcggctcctcaacatcgcagggctttgcacactcacctacacttgcagcaggcgggaaagggaaggaagccaccgtccactgccccttattctcctggcacacttggctgattaaggcagtgttcaagctcaggtcgaggctgcagctgattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccga

SEQ ID NO: 385077 - DNA, 1208 bp, Homo sapiens
gcagcggccgcgtcgacgggcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaccgaatagcttagttcattcattctctctgaactcaggctgcaggtagggattggatggtgctgggtgaggctgggcaggacttctctatgtctccgtgaggctgcttagagcctcttggaagaagtggtgttttggtcacccgtcgctgtacaagccaaggcttggtggcttaaatcagccattttacattgttcacgattttgtgaggcatttgggatgggctcagctgagcagtttgtctgatctgtgtggcattaactgcaggacccacttccaagatggcaccggctctcctgtctggggtctcagtgctcctcaggctgtacgtagcacctcctcaggcagggcccacagcgtggcttgcactgccccacagtgagcttcccgagagtgtcccgagagacccaagcagatgctacgaggcttcctatgacccagcctcagaaattccagcgtgtcatttctaccgcactctttcagtccctagggtgagcccagattcagggggaggcaaggagctccccttgctagaggatgaccacacctacaactggtaaggacttggagggatggagtgggctggtcc

SEQ ID NO: 385078 - DNA, 1155 bp, Homo sapiens
gcagcggccgcgtcgacgggcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgaccgaatagcttagttcattcattctctctgaactcaggctgcaggtagggattggatggtgctgggtgaggctgggcaggacttctctatgtctccgtgaggctgcttagagcctcttggaagaagtggtgttttggtcacccgtcgctgtacaagccaaggcttggtggcttaaatcagccattttacattgttcacgattttgtgaggcatttgggatgggctcagctgagcagtttgtctgatctgtgtggcattaactgcaggacccacttccaagatggcaccggctctcctgtctggggtctcagtgctcctcaggctgtacgtagcacctcctcaggcagggcccacagcgtggcttgcactgccccacagtgagcttcccgagagtgtcccgagagacccaagcagatgctacgaggcttcctatgacccagcctcagaaattccagcgtgtcatttctaccgcactctttcagtccctagggtgagcccagattcagggggaggcaaggagctccccttgctagaggatgaccacacctacaactggtaaggacttggagggatggagtgggctggtcc

SEQ ID NO: 385079 - DNA, 652 bp, Homo sapiens
gcagcggccgcgtcgacgggcagacgcaggggtcggcgccgggtgagagcgtgcggccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccgataaaaaaaaaatcaggcctcgttggtctaaat

SEQ ID NO: 385080 - DNA, 610 bp, Homo sapiens
tgatccagaggttagcccaacaacagtcgtacacgcagggtcggcgccggattcaccacaacatggcaaatctttttataaggaaaatggtgaaccctctgctctatctcagtcgtcacacggtgaagcctcgagccctctccacatttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacagatgtagaccctttccctccagagtcacgcacatactcgtcatcgcatcacttgggagaatggttgtatcttatggaaggaattatcacatcaaggagtcaggggaaagtgactggaagcaaacgccctaaaagttacccatcacgtttcagtgtaaatgagtaactatagaagacattgcgttatcttatttccaaaacgttccaactaaaaaacattttcctattaaaatagaccttccga

SEQ ID NO: 385081 - DNA, 1332 bp, Homo sapiens
atgagaaggaggggaagtcttgagattttgtccaaagcatctctggctgttacaaacaagaggcctgagcttggctgggccacttgctagcctttccaggggcagagacaggaacaacagtcttctcctaggtcccatctgtctgtgatttcatggcttagaggggtcactgagaaggctactaggtagggatatcttggcccttatatgttgcttcttcccttccgaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtcagtattccttgccctccccaccccacgccccgcaccccccaccattgctgttttggcctctcttagctcatccatctgctgccctcagtccactcactaagggtgctgaggaaggaggcataagaagtcctttcttccaggcactgtccagtgatcctaatgattctcaattctctgagactcagtgactcctttttataacaaatattttgcttgaatttaattaatagataagtcataggtaaatccacatatgatttctacaaaacttaatatgctactctaataaatataaaagaaaaacaagaaaagtaatttgtaaggacaatatatacaatgtaatataataaggtaaaaatacaaaacaacagtagttgtattgagtacaactttgttaaaagaaatagcaaagtggcctgggcacagtggctcacgagtgtaatcccagcactaatcccagcactttgggaggctgaggagggtggatcacgaggtcaggagatcgagaccatcctggctaacatggtgaaaccccatctctactaaaaaaaatacaaaaaatgccgggcgtggtggcgggcgcctgtagtcctagctactcgggaggctaaggcaggagaatggcgtgaacccgggaggcggagcttgcagtgagctgagatcgtgccattgcactccagccagggtgacagagcgagactccgtctcaaaaa

SEQ ID NO: 385082 - DNA, 1662 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtcagtattccttgccctccccaccccacgccccgcaccccccaccattgctgttttggcctctcttagctcatccatctgctgccctcagtccactcactaagggtgctgaggaaggaggcataagaagtcctttcttccaggcactgtccagtgatcctaatgattctcaattctctgagactcagtgactcctttttataacaaatattttgcttgaatttaattaatagataagtcataggtaaatccacatatgatttctacaaaacttaatatgctactctaataaatataaaagaaaaacaagaaaagtaatttgtaaggacaatatatacaatgtaatataataaggtaaaaatacaaaacaacagtagttgtattgagtacaactttgttaaaagaaatagcaaagtggcctgggcacagtggctcacgagtgtaatcccagcactaatcccagcactttgggaggctgaggagggtggatcacgaggtcaggagatcgagaccatcctggctaacatggtgaaaccccatctctactaaaaaaaatacaaaaaatgccgggcgtggtggcgggcgcctgtagtcctagctactcgggaggctaaggcaggagaatggcgtgaacccgggaggcggagcttgcagtgagctgagatcgtgccattgcactccagccagggtgacagagcgagactccgtctcaaaaa

SEQ ID NO: 385083 - DNA, 456 bp, Homo sapiens
cttttctgagaaaacactagtgatattttaatggcaaatgacttcttgtatcaacacacaagtatatgccagtattcatgtggttcttccaggtagcttctccaccagattgtggccttctggaaaaccctagcagaggctaaacaaagtcccaggtccagagatagactggtccagagacagatgtgatcctaggtccagagatacactgtgaccatgggatggatggactctaggagccagtctttgggaggccgaggtccctgagctgatggggtagtgttgtctgtttcaggtctcccggggcctcagtgccagcaccatggacctctcttcaagcagctgacattcaacccggcccccaggtaaccagaggggagacaaggcactatccatcccctctcagcatatcttggaggcctgagcagcagctggggcccatcttctaaagcttga

SEQ ID NO: 385084 - DNA, 436 bp, Homo sapiens
gcctcccagaccttttcccttcctcccgtagactttccctcagctttagctctgttccctctcctattttcttattttttttcctcttgtcttgcttggaagacaaatgttttgttttctgaactcattctctcttccttctctggtctctttctcaccacagccccacagtgaacactactctgagaaacctgggagctctgtataggcgccagggaaagctggaggctgctgagaccctggaggaatgtgccctgcggtcccggagacaggtcagaagcccagaggggaaggaggtcctagagggaagggccctggggatgagagagtgccgaggtttcttgggagtctcctaagaataagcggaaaggctgatgaagccaggagggagaggaaagtgaggcagtgttgtgattgtggttgtttttaagcatgt

SEQ ID NO: 385085 - DNA, 2543 bp, Homo sapiens
acatgccctggtgcagaacagagaagcgaaacctagaaataatcaaggcttgttccagaccttcagagttctcgcagcctgcctgtcttgtgtgtgtgtagattcagatatagacaagatatcatctgtaggtagagatgtaaatatagacatagctcagctattactcgggaggccgtggcatgagaatcgcttgaacccaggaggcagaggttacagtgagccaggattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385086 - DNA, 2416 bp, Homo sapiens
gagccactgtgcctggccctgattttactttgagcgagatggaaactattggaatgtttttagaagaggagtgatgtggtctaacttggcatcatcaggttgttgggttacaaatagacaataggggaacaagggcagaaacgaggccagtgaggaagttattgtaataatttgggtaggaattgatagtggcttggtccagggtgacagcagtggaggtagtgggaaattggattcagggtatgttttgaaggtagcaccactgctacacccccaccttctggctcctctgtgcccctgccagtcttgccacgtcccagtaggctccccttccacctgttcctgaatactcccacccagaatctggagctcaggggatgtgcccacctaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385087 - DNA, 2020 bp, Homo sapiens
atgagaaggaggggaagtcttgagattttgtccaaagcatctctggctgttacaaacaagaggcctgagcttggctgggccacttgctagcctttccaggggcagagacaggaacaacagtcttctcctaggtcccatctgtctgtgatttcatggcttagaggggtcactgagaaggctactaggtagggatatcttggcccttatatgttgcttcttcccttccgaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385088 - DNA, 2012 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385089 - DNA, 2428 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttctgtgacttgagtcctgattgaagagggtatgaagcagggcttgtgttggggcccttcacagaaggtgaggggcagtga

SEQ ID NO: 385090 - DNA, 1906 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385091 - DNA, 2024 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385092 - DNA, 850 bp, Homo sapiens
cagtccgttcgactgagctgatagggtcagtgccagcaccatggacctctcttcaggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385093 - DNA, 769 bp, Homo sapiens
cttttctgagaaaacactagtgatattttaatggcaaatgacttcttgtatcaacacacaagtatatgccagtattcatgtggttcttccaggtagcttctccaccagattgtggccttctggaaaaccctagcagaggctaaacaaagtcccaggtccagagatagactggtccagagacagatgtgatcctaggtccagagatacactgtgaccatgggatggatggactctaggagccagtctttgggaggccgaggtccctgagctgatggggtagtgttgtctgtttcaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385094 - DNA, 756 bp, Homo sapiens
caggcaagtaaagtaagcccttgcctccaactcctcttggctcctgatctctggagaagtatctcggagagaaacagggaggaagtcaacgggccagccatggagagagagtttgggtagaatgggtgccccagtgtggcagtgctcaagaggcccacagccttaaggccactcaggaggaagagaggaggcctcaattcttccgttttccattgtagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385095 - DNA, 322 bp, Homo sapiens
acaatttggctgtgctctatggcaaaaggggcaagtacaaggaggcagagcctctgtgccagcgggcactggagattcgagaaaaggtacccatgccctctctcccttcttctcttgtcgctgtgacccttctctacatggctcctctggtctaaccctcctccttcactttttttttctcacccccatctctgctttgttctctcttccttcattccctttcctctgctttccacatgtgtgtgcctacatgcaaacacacgtgtgcttgtgcacacacatgttatcatagccatttatccactcctttgttccctttcag

SEQ ID NO: 385096 - DNA, 367 bp, Homo sapiens
gctcaaggctaccggggtctctgtcttactccttgcattagcccaactctcacttcccatcccagcaccagccccagatgcatggtgtcctccccagcccagcctgcaccctagccccatgccaccttgcatctcagcatctctgtattcttatatttggctctccctgcccttctttctggcctctctctgtcctgcagagccggcaccatgagggtgggacaccctatgctgagtatggaggctggtacaaggcctgcaaagtgagcaggtgagctgacagtgaaaagccagcttggcctccgatgccctccatccagtccctgctcccagcctcccagaccttttcccttcctcccgtagactt

SEQ ID NO: 385097 - DNA, 2350 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385098 - DNA, 2477 bp, Homo sapiens
acatgccctggtgcagaacagagaagcgaaacctagaaataatcaaggcttgttccagaccttcagagttctcgcagcctgcctgtcttgtgtgtgtgtagattcagatatagacaagatatcatctgtaggtagagatgtaaatatagacatagctcagctattactcgggaggccgtggcatgagaatcgcttgaacccaggaggcagaggttacagtgagccaggattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385099 - DNA, 2289 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggagaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385100 - DNA, 2048 bp, Homo sapiens
acatgccctggtgcagaacagagaagcgaaacctagaaataatcaaggcttgttccagaccttcagagttctcgcagcctgcctgtcttgtgtgtgtgtagattcagatatagacaagatatcatctgtaggtagagatgtaaatatagacatagctcagctattactcgggaggccgtggcatgagaatcgcttgaacccaggaggcagaggttacagtgagccaggattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385101 - DNA, 2297 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaaggtgggtacaaagcaggtatggccctcagagatgcagcctgctgctggcttttcagtcagagggttgggggctggccagccaagctgccttgccctggcccttaaataaaagaatcaggtaacctttc

SEQ ID NO: 385102 - DNA, 2295 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcagccccacagtgaacactactctgagaaacctgggagctctgtataggcgccagggaaagctggaggctgctgagaccctggaggaatgtgccctgcggtcccggagacagggcactgaccctatcagccagacgaaggtggcagagctgcttggggagagtgatggtagaaggacctcccaggagggccctggagacagtgtgaaattcgagggaggtgaagatgcttctgtggctgtggagtggtccggggatggcagtgggaccctgcagaggagtggctctcttggcaagatccgggatgtgctccgcagaagcagtgaactcttggtgaggaagctccaggggactgagcctcggccctccagcagcaacatgaagcgagcagcctccttgaactatctgaaccaacctagtgcagcacccctccaggtctcccggggcctcagtgccagcaccatggacctctcttcaagcagctgacattcaacccggcccccaggtctgctgggtccccccacccccacagccctcacagcattccccattgctcctggctcttccccacccctaggtgggacagtgaaggggagcagtttaaccagaagattgctgctgcccttagggtctcagctccctcctcaggaatccctcttaggaaggaccctcaggacaccctctctgcaccctgtggtcctctagagtagctagctctgaggccccaagtcagagggttgggggctggccagccaagctgccttgccctggccgctcttactccctccctctgctgtctcacttcaggtccatgtatttcacttttcttaaataaaagaatcaggtaacctttc

SEQ ID NO: 385103 - DNA, 1663 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcgtgaccagaataagtataaggaagctgcccacctgctgaatgatgcccttagcatccgggagagcaccttgggacctgaccatcctgctgtggctgccacactcaacaatttggctgtgctctatggcaaaaggggcaagtacaaggaggcagagcctctgtgccagcgggcactggagattcgagaaaaggtcctgggcacgaatcatccagatgtggcaaaacagctgaacaacctggccctcttgtgccaaaaccagggcaagtatgaggccgtggaacgctactaccagcgagcactggccatctacgaggggcagctggggccggacaaccctaatgtagcccggaccaagaacaacctggcttcctgttacctgaaacagggcaaatatgctgaggctgagacactatacaaagagatcctgacccgtgcccatgtacaggagtttgggtctgtggatgatgaccacaagcccatctggatgcatgcagaggagcgggaggaaatgagcaaaagccggcaccatgagggtgggacaccctatgctgagtatggaggctggtacaaggcctgcaaagtgagcaggtgagctgacagtgaaaactagctctgaggccccaaggtgggtacaaagcaggtatggccctcagagatgcagcctgctgctggcttttcagtcagagggttgggggctggccagccaagctgccttgccctggccgctcttactccctccctctgctgtctcacttcaggtccatgtatttcacttttcttaaataaaagaatcaggtaacctttc

SEQ ID NO: 385104 - DNA, 1101 bp, Homo sapiens
gcacgagccggcaagagcggcagccacaccggcagattgcagaccgggcaaggtcccccaggccaggatgtcaggcctggtgttggggcagcgggatgagcctgcaggccaccggctcagccaagaggagatcctggggagcacacggctggtcagccaagggctagaggccctacgcagtgaacaccaggccgtgctgcaaagcctgtcccagaccattgagtgtctgcagcagggaggccatgaggaagggctggtgcatgagaaggcccggcagcttcgccgttctatggaaaacattgagctcgggctgagtgaggcccaggtgatgctggctctagccagccacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggagaaagaaggcgatgccaccaaggattccctggatgacctctttcctaatgaggaggaagaggaccccagcaatggcttgtcccgtggtcaaggtgctacagcagctcagcagggtggatatgagatcccagcaaggttgcggacgttgcacaacctggtgatccagtacgcagcccaaggtcgctatgaggtggccgtgccactctgtaagcaggcactagaggacctggagcgcacatcaggccgtggccaccctgatgtcgccaccatgctcaacatccttgctttggtgtatcggtgaggacttccctcctccagtgcccagatcttcccccacattcccaccttggtcctcctttggctttcatttttcctctttacagggtacctctcctccctgttgggcctcccagatacaccccaacagggtgcttctttatgtgccagaactctcacttttcccatacctaagcatttgctcatcccttgggatccttgttcctctaatctctcttctggggagtgctctctccctctctt

SEQ ID NO: 385105 - DNA, 719 bp, Homo sapiens
  misc_feature (626)..(626): n is a, c, g, or t
agggagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagtatttaaattactacactgtattcatacctggagaatatcattatgtgacttaaaaatttaagtttcactactctgagcattacataaagccatagcatgcttaaagaatttatactgctaccttttaaagtcactaaaatcttttaaatggtgaatgtctaanagtcagtcttcaggtatacctgacaaaggatgagaaatgagcttttgtagaaatagaactttattttaataaaaatgtgttacatttgtgtct

SEQ ID NO: 385106 - DNA, 739 bp, Homo sapiens
gcagttaattgaaatggccatcaacttgaagaaagggtcttccagtcacagttgttaccaaacactcccttagtgacattcctctagagggacccattacagactgagatatatactaaattagacctgaaaacccttgatttgtagtccaaaatctttatatccaaatgtctgtttccaatttacaaacacacttaatactcagcctccctttcttgcgtcgttacactgaacagcagccaagctgctctggacaaagaggatcatttcaccgcctgtgcagggaaccatctggagccaattatcttctccaagagatcttctttacctctgaagaaagcccggggccgcatgttcctttgcctctctttcacaaattatagtcatgttaatcccacctcagacaccccatgatcacaaaaactttattcttcaataccttcttctttctcctttatttctggaaaatgttaatgtctttctcttccgtttcttctctctccttttctttgttccataatatccatttaatagatattaaaaaatatctattctcagatgtttcgtcagtatttttacatgctgataattctttttcccttttcctagataaaactgtcaatgcaactacatatgaaaaatccaccattgaagaagaaacaactactagcgaaccctctcataaaaatattcaaagtatttaaattactacactgtattcatacctggagaatatcat

SEQ ID NO: 385107 - DNA, 1036 bp, Homo sapiens
agggagacacaggacctgctgggccacagaaaggaggctctgggtagacgcactagattactggataaatcacttcaatttcccaatgaattttatattgtttatttttatacctggagttttttccttaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtcatca

SEQ ID NO: 385108 - DNA, 987 bp, Homo sapiens
gtgtgatacttttttttagcattgcctaatgtgctacctttaaatgaagatgttaataagcaggaagaaaagaatgaagatcatactcccaattatgctcctgctaatgagaaaaatggcaattattataaagatataaaacaattgcatgttttaagaaaaaaactcagaggaagaaaaaggtaaaggaaaaaaagtgacttagctagttgctgaagactttcgcttttgtttttagatgtgttcacaacacaaaatccaaatggcactgagtctgaaatatctgtgagagccacaactgacctgaattttgctctaaaaaacgataaaactgtcaatgcaactacatatgaaaaatccaccattgaagaagaaacaactactagcgaaccctctcataaaaatattcaaagatcaaccccaaacgtgcctgcattttggacaatgttagctaaagctataaatggaacagcagtggtcatggatgataaagatcaattatttcacccaattccagagtctgatgtgaatgctacacagggagaaaatcagccagatctagaggatctgaagatcaaaataatgctgggaatctcgttgatgaccctcctcctctttgtggtcctcttggcattctgtagtgctacactgtacaaactgaggcatctgagttataaaagttgtgagagtcagtactctgtcaacccagagctggccacgatgtcttactttcatccatcagaaggtgtttcagatacatccttttccaagagtgcagagagcagcacatttttgggtaccacttcttcagatatgagaagatcaggcacaagaacatcagaatctaagataatgacggatatcatttccataggctcagataatgagatgcatgaaaacgatgagtcggttacccggtgaagaaatcaaggaacccggtgaagaaatcttattgatgaataaataactttaattattttgtcatca

SEQ ID NO: 385109 - DNA, 479 bp, Homo sapiens
gctttccaggccatctctgtgcaactccaaaggggcttttcagttgatgtctttttttttttcctctgattgacctatgctctctcgggtcagtgttgagccataatggattaggcagagacatttcttgtgcaaatgagatgctcctctcacttcaaccctgagcccctccagggctggctacataatttacaagactcaatgcaaagtgaaaatgtggagctgcttgttcaaaagcaggaaaaaaagtgttaacggtactaaaattaattttttaactttctttggcagtttctctctagatctgccatggtgttaaaaaaattatttactgttgctcctccacaagtatgtggatactcacagggagagtgcagactcccagaggtgcgcagggtccctgtcccgctacttggtgtgtgcaggacccaccagctgccagggtccccctgtcaccagcaccctggtagtcagggaca

SEQ ID NO: 385110 - DNA, 413 bp, Homo sapiens
acaataataaaatgatataaggaaatttatctgtatcaaaaaatttcattgaggctattaattttacaaaaaccatagagaatgcttcatgaaactacattatatagtactttttagtattttacttacattttaaatcatcaacaaattaaaggaagttcttaataattatttattaccaataacatgattctactcaagcaatccttttgagattaagtattttaaataaaactttaaaaacaaatggtaccgactgatatcagctttcaatgaaataatacttctgtatttgtagtaatgtgaagtataactttctcctcacagtggatcttttataacatcagtattagtgttttctctgatataaacactgtgatactcacagctttcctgtatccatacattacatg

SEQ ID NO: 385111 - DNA, 495 bp, Homo sapiens
agaagtggatgaccttaggatatattttaaagttatagccaaggggttgctggtggattagatgtagagagtgagagaaaaaaggaatcaagagtgactcttggtttttgatttgagcaattggatgaacaataatgccatttatggaaatgggaaaaactggggagaaaagttctggagggggtgaaaatcaagaatagagaattcttttgaagaatacagaatagagattaagttggagaggcccatttagtcatccaagtggagatactaagaaggaagtaaactgtgagtctggagcttatggaggagggcactttagggctggggaaactaatctgggagtcatcagcttacaggtaaccatgccagtggatgaaattatgtggggagtgaatgtagagttgtgaaaattctcacagtttacatcaagtacgtatggaagctgcttaacactttcaatttagaaacctttgtgatacatctgggaaggta

SEQ ID NO: 385112 - DNA, 333 bp, Homo sapiens
tcaaaaaaaaaaataaaaaataaaaaataattttaaaaaaggcagcagatgccttagccaaccagattcaaagggagagctaggaagttcacttgtgggaaattagactcttttccaggacttctcctataaagtcattcatggggacttgcataatgttgtccagaagaaaattctattggggacaacattaattcaccaaagattctcttttgtattatttatttgttaaaataaaatttttttagagataggtttctctctgtcacccaggctagagtgcagtggcttgatcacggctcactgcagccttgacctccttggctgaagcga

SEQ ID NO: 385113 - DNA, 1026 bp, Homo sapiens
  misc_feature (729)..(729): n is a, c, g, or t
ttcaaggttacccatctcaagtagcctagcaatattggcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcctttctcctgcctgaaggacagacatgactttggattcccccaggaggagtttgatggcaaccagttccagaaggctcaagccatctctgtcctccatgagatgatccagcagaccttcaatctcttcagcacaaaggactcatctgctacttgggaacagagcctcctagaaaaattttccactgaacttaaccagcagctgaatgacctggaagcctgcgtgatacaggaggttggggtggaagagactcccctgatgaatgtggactccatcctggctgtgaagaaatacttccaaagaatcactctttatctgacagagaagaaatacagcccttgtgcctgggaggttgtcagagcagaaatcatgagatccttctctttatcaaaaatttttcaagaaagattaaggaggaaggaatgaaacctgtttcaacatggaaatgatctgtattgactaatacaccagtccacacttctatgacttctgccatttcaaagactcatttctcctataaccaccgcatgagttgantcaaaattttcagatcttttcaggagtgtaaggaaacatcatgtttacctgtgcaggcactagtcctttacagatgaccatgctgatagatctaattatctatctattgaaatatttatttatttattagatttaaattatttttgtccatgtaatattatgtgtacttttacattgtgttatatcaaaatatgttaatctaatatttagtcaatatattattttctttttattaatttttactattaaaacttcttatattatttggttattctttaataaagaaattccaagccc
